United States Patent
Boer et al.

(10) Patent No.: US 10,689,681 B2
(45) Date of Patent: Jun. 23, 2020

(54) MICROORGANISMS FOR DITERPENE PRODUCTION

(71) Applicant: DSM IP ASSETS B.V., Heerlen (NL)

(72) Inventors: Viktor Marius Boer, Echt (NL); Erwin Suir, Echt (NL)

(73) Assignee: DSM IP ASSETS B.V., Heerlen (NL)

( * ) Notice: Subject to any disclaimer, the term of this patent is extended or adjusted under 35 U.S.C. 154(b) by 0 days.

(21) Appl. No.: 14/893,216

(22) PCT Filed: Jun. 2, 2014

(86) PCT No.: PCT/EP2014/061399
§ 371 (c)(1),
(2) Date: Nov. 23, 2015

(87) PCT Pub. No.: WO2014/191581
PCT Pub. Date: Dec. 4, 2014

(65) Prior Publication Data
US 2016/0177360 A1   Jun. 23, 2016

Related U.S. Application Data

(63) Continuation of application No. 13/907,795, filed on May 31, 2013, now abandoned.

(51) Int. Cl.
| | |
|---|---|
| C12P 19/56 | (2006.01) |
| C12N 9/88 | (2006.01) |
| C12N 9/02 | (2006.01) |
| C12N 9/16 | (2006.01) |
| C12N 15/52 | (2006.01) |
| C12N 9/90 | (2006.01) |
| C07K 14/39 | (2006.01) |
| C12N 9/10 | (2006.01) |
| C12N 9/24 | (2006.01) |
| A23L 27/30 | (2016.01) |
| A23L 2/60 | (2006.01) |
| C07K 14/395 | (2006.01) |
| C12P 15/00 | (2006.01) |
| C07H 15/256 | (2006.01) |

(52) U.S. Cl.
CPC ............... *C12P 19/56* (2013.01); *A23L 2/60* (2013.01); *A23L 27/36* (2016.08); *C07H 15/256* (2013.01); *C07K 14/39* (2013.01); *C07K 14/395* (2013.01); *C12N 9/0036* (2013.01); *C12N 9/0042* (2013.01); *C12N 9/0073* (2013.01); *C12N 9/0083* (2013.01); *C12N 9/1051* (2013.01); *C12N 9/16* (2013.01); *C12N 9/2405* (2013.01); *C12N 9/88* (2013.01); *C12N 9/90* (2013.01); *C12N 15/52* (2013.01); *C12P 15/00* (2013.01); *A23V 2002/00* (2013.01)

(58) Field of Classification Search
None
See application file for complete search history.

(56) References Cited

U.S. PATENT DOCUMENTS

| | | | |
|---|---|---|---|
| 6,090,574 A | 7/2000 | Giuseppin et al. | |
| 6,265,186 B1 | 7/2001 | Swinkels et al. | |
| 6,995,003 B1 | 2/2006 | Nieboer et al. | |
| 7,402,383 B2 | 7/2008 | Bovenberg et al. | |
| 9,738,890 B2 | 8/2017 | Roubos et al. | |
| 2005/0130140 A1 | 6/2005 | Bovenberg et al. | |
| 2006/0127972 A1 | 6/2006 | Nieboer et al. | |
| 2007/0059790 A1 | 3/2007 | Miller et al. | |
| 2007/0298455 A1 | 12/2007 | Van Den Berg | |
| 2014/0170708 A1* | 6/2014 | Zieler ............... | C12N 15/1027 435/91.2 |
| 2015/0307562 A1* | 10/2015 | Basu ................... | A61K 38/16 530/350 |
| 2016/0177360 A1* | 6/2016 | Boer ................... | A23L 2/60 435/78 |
| 2017/0314011 A1 | 11/2017 | Roubos et al. | |

FOREIGN PATENT DOCUMENTS

| | | |
|---|---|---|
| EP | 0481008 A1 | 4/1992 |
| EP | 0635574 A1 | 1/1995 |
| EP | 1499708 B1 | 1/2006 |
| WO | 90/14423 A1 | 11/1990 |
| WO | 98/46772 A2 | 10/1998 |

(Continued)

OTHER PUBLICATIONS

Carrier et al. (Plant Cell Reports, vol. 15, Sep. 1996, pp. 888-891).*
International Search Report from corresponding PCT/EP2014/061399, dated Jan. 12, 2015.
Gionata et al., "Dynamic control of gene expression in *Saccharomyces cerevisiae* engineered for the production of plant sesquiterpene alpha-santalene in a fed-batch mode", Metabolic Engineering, vol. 14, No. 2, Feb. 8, 2012, pp. 91-103, XP028466089.
Tokuhiro et al., "Overproduction of Geranylgeraniol by Metabolically Engineered *Saccharomyces cerevisiae*", Applied and Environmental Microbiology, vol. 75, No. 17, Jul. 10, 2009, pp. 5536-5543, XP002576694.

(Continued)

*Primary Examiner* — Hope A Robinson
(74) *Attorney, Agent, or Firm* — McBee Moore & Vanik IP, LLC

(57) ABSTRACT

The present invention relates to a recombinant microorganism comprising one or more nucleotide sequence(s) encoding: a polypeptide having ent-copalyl pyrophosphate synthase activity; a polypeptide having ent-Kaurene synthase activity; a polypeptide having ent-Kaurene oxidase activity; and a polypeptide having kaurenoic acid 13-hydroxylase activity, whereby expression of the nucleotide sequence(s) confer(s) on the microorganism the ability to produce at least steviol. The recombinant microorganism may also be capable of expressing one or more UDP-glucosyltransferases such that the microorganism is capable of producing one or more steviol glycosides.

26 Claims, 17 Drawing Sheets
(1 of 17 Drawing Sheet(s) Filed in Color)

Specification includes a Sequence Listing.

(56) References Cited

FOREIGN PATENT DOCUMENTS

| WO | 99/60102 A2 | 11/1999 |
|---|---|---|
| WO | 00/37671 A2 | 6/2000 |
| WO | 03/010183 A2 | 2/2003 |
| WO | 03/010311 A2 | 2/2003 |
| WO | 03/062430 A1 | 7/2003 |
| WO | 2004/099381 A2 | 11/2004 |
| WO | 2005/05672 A1 | 1/2005 |
| WO | 2005/026356 A1 | 3/2005 |
| WO | 2005/040186 A2 | 5/2005 |
| WO | 2006/009434 A1 | 1/2006 |
| WO | 2006/096130 A1 | 9/2006 |
| WO | 2007/147637 A2 | 12/2007 |
| WO | 2008/053019 A2 | 5/2008 |
| WO | 2011153378 A1 | 12/2011 |
| WO | 2012075030 A1 | 6/2012 |
| WO | 2013022989 A2 | 2/2013 |
| WO | 2013110673 A1 | 8/2013 |
| WO | 2013/135728 A1 | 9/2013 |
| WO | 2013/144257 A1 | 10/2013 |

OTHER PUBLICATIONS

Faulkner et al., "The LPPI and DPPPI Gene Products Account for Most of the Isoprenoid Phsophate Phosphatase Activities in *Saccharomyces cerevisiae*", Journal of Biological Chemistry, vol. 274, No. 21, May 21, 1999, pp. 14831-14837, XP002908896.

Oshiro et al., "Diacylglycerol pyrophosphate phosphatase in *Saccharomyces cerevisiae*", Biochimica and Biophysica Acta, vol. 1635, No. I, Nov. 30, 2003, pp. 1-9, XP004476013.

Toke et al., "Isolation and Characterization of the *Saccharomyces cerevisiae* DPPI Gene Encoding Diacylg Lycerol Pyrophosphate Phosphatase", Journal of Biological Chemistry, vol. 273, No. 6, Feb. 6, 1998, pp. 3278-3284, XP002908892.

Hitesh et al, "A comprehensive analysis of fifteen genes of steviol glycosides biosynthesis pathway in Stevia rebaudiana (Bertoni )",Gene, vol . 492, No. 1, Oct. 20, 2011, pp. 276-284, XP028345135.

Brand et al., "Steviol glycoside biosynthesis", Phytochemistry, vol. 68, No. 14, Mar. 29, 2007, pp. 1855-1863, XP022145443.

Norihikomi, "Pathway engineering for functional isoprenoids", Current Opinion in Biotechnology, vol. 22, No. 5, Oct. 1, 2011, pp. 627-633, XP055012413.

I. Farkass et al., "Two Glycogen Synthaselsoforms in *Saccharomyces cerevisiae* are Coded by Distinct Genes that are Differentially Controlled", J. Bio L. Chem., vol. 266, No. 24, Aug. 25, 1991, pp. 15602-15607, XP055159777.

Francois et al., "Reserve carbohydrates metabolism in the yeast *Saccharomyces cerevisiae*", FEMS MI Crobiology Reviews, vol. 25, 2001, pp. 125-145, XP055159870.

Queiroz-Claret et al., "Time-co-ordinated control of glycogen synthase, protein phosphatase 2A and protein kinase CK2 during culture growth in Yarrowialipolytica in relation to glycogen metabolism", Comptes Rendus Des Seances De L'Acad Emiedes Sciences, Serie III: Sci Ences De La Vie, vol. 323, No. 3, Mar. 1, 2000, pp. 257-266, XP004341533.

\* cited by examiner

MICROORGANISMS FOR DITERPENE PRODUCTION

CROSS REFERENCE TO RELATED APPLICATIONS

This application is a § 371 National Stage Application of PCT/EP2014/061399, filed 2 Jun. 2014, which claims priority to U.S. Ser. No. 13/907,795, filed 31 May 2013.

BACKGROUND

Field of the Invention

The present invention relates to a process for the extracellular production of a diterpene and/or a glycosylated diterpene using a recombinant microorganism. The invention further relates to a fermentation broth comprising a diterpene and/or glycosylated diterpene obtainable by such a process.

Description of Related Art

The worldwide demand for high potency sweeteners is increasing and, with blending of different artificial sweeteners, becoming a standard practice. However, the demand for alternatives is expected to increase. The leaves of the perennial herb, Stevia rebaudiana Bert., accumulate quantities of intensely sweet compounds known as steviol glycosides. Whilst the biological function of these compounds is unclear, they have commercial significance as alternative high potency sweeteners, with the added advantage that Stevia sweeteners are natural plant products.

These sweet steviol glycosides have functional and sensory properties that appear to be superior to those of many high potency sweeteners. In addition, studies suggest that stevioside can reduce blood glucose levels in Type II diabetics and can reduce blood pressure in mildly hypertensive patients.

Steviol glycosides accumulate in Stevia leaves where they may comprise from 10 to 20% of the leaf dry weight. Stevioside and rebaudioside A are both heat and pH stable and suitable for use in carbonated beverages and many other foods. Stevioside is between 110 and 270 times sweeter than sucrose, rebaudioside A between 150 and 320 times sweeter than sucrose. In addition, rebaudioside D is also a high-potency diterpene glycoside sweetener which accumulates in Stevia leaves. It may be about 200 times sweeter than sucrose.

Currently, steviol glycosides are extracted from the Stevia plant. In Stevia, (−)-kaurenoic acid, an intermediate in gibberellic acid (GA) biosynthesis, is converted into the tetracyclic dipterpene steviol, which then proceeds through a multi-step glucosylation pathway to form the various steviol glycosides. However, yields may be variable and affected by agriculture and environmental conditions. Also, Stevia cultivation requires substantial land area, a long time prior to harvest, intensive labour and additional costs for the extraction and purification of the glycosides.

New, more standardized, clean single composition, no after-taste, sources of glycosides are required to meet growing commercial demand for high potency, natural sweeteners.

SUMMARY

In Stevia, steviol is synthesized from GGPP, which is formed by the deoxyxylulose 5-phosphate pathway. The activity of two diterpene cyclases (−)-copalyl diphosphate synthase (CPS) and (−)-kaurene synthase (KS) results in the formation of (−)-Kaurene which is then oxidized in a three step reaction by (−)-kaurene oxidase (KO) to form (−)-kaurenoic acid.

In Stevia leaves, (−)-kaurenoic acid is then hydroxylated, by ent-kaurenoic acid 13-hydroxylase (KAH) to form steviol. Steviol is then glucosylated by a series of UDP-glucosyltransferases (UGTs).

This invention relates to a microorganism capable of producing a diterpene, such as steviol, or a glycosylated diterpene (i.e. a diterpene glycoside), such as steviolmonoside, steviolbioside, stevioside, rebaudioside A, rebaudioside B, rebaudioside C, rebaudioside D, rebaudioside E, rebaudioside F, rubusoside or dulcoside A.

In co-pending patent application WO2013/110673, recombinant microorganisms are described which are capable of the production of diterpenes or diterpene glycosides. Herein, are described recombinant microorganisms which comprise additional modifications, in particular the down-regulation of one or more genes, which lead to increased levels of production of a diterpene or diterpene glycoside.

According to the invention, there is thus provided a recombinant microorganism comprising one or more nucleotide sequence(s) encoding:

a polypeptide having ent-copalyl pyrophosphate synthase activity;

a polypeptide having ent-Kaurene synthase activity;

a polypeptide having ent-Kaurene oxidase activity; and a polypeptide having kaurenoic acid 13-hydroxylase activity, whereby expression of the nucleotide sequence(s) confer(s) on the microorganism the ability to produce at least steviol, and wherein said recombinant microorganism has been modified in its genome such that it results in a deficiency in the production of one or more of:

(i) a phosphatase capable of acting on geranylgeranylpyrophosphate (GGPP) resulting in the formation of geranylgeraniol (GOH);

(ii) a phosphatase capable of acting on farnesylpyrophosphate (FPP) resulting in the formation of farnesol and nerolidol;

(iii) an exo-1,3-β glucanase;

(iv) a glycogen synthase (or a polypeptide that influences glycogen accumulation);

(v) a transcriptional repressor of hypoxic genes (vi) an NADPH oxidase; or (vii) a monocarboxylate transporter (viii) a polypeptide encoded by the open reading frame, YJL064w; or (ix) a polypeptide encoded by open reading frame, YPL062w.

One or more of these modifications ultimately resulting in improved production of diterpene and or diterpene glycosides in the metabolically engineered strain The invention also relates to such a recombinant microorganism, wherein said recombinant microorganism has been modified in its genome such that it results in a deficiency in the production of one or more of:

(i) a phosphatase capable of acting on geranylgeranylpyrophosphate (GGPP) resulting in the formation of geranylgeraniol (GOH) comprising an amino acid sequence having at least about 30% sequence identity with SEQ ID NO: 225;

(ii) a phosphatase capable of acting on farnesylpyrophosphate (FPP) resulting in the formation of farnesol and nerolidol comprising an amino acid sequence having at least about 30% sequence identity with SEQ ID NO: 227;

(iii) an exo-1,3-β glucanase comprising an amino acid sequence having at least about 30% sequence identity with SEQ ID NO: 229 or 231;

(iv) a glycogen synthase (or a polypeptide that influences glycogen accumulation) comprising an amino acid sequence having at least about 30% sequence identity with SEQ ID NO: 233, 235 or 250;

(v) a transcriptional repressor of hypoxic genes comprising an amino acid sequence having at least about 30% sequence identity with SEQ ID NO: 237;

(vi) an NADPH oxidase comprising an amino acid sequence having at least about 30% sequence identity with SEQ ID NO:239;

(vii) a monocarboxylate transporter comprising an amino acid sequence having at least about 30% sequence identity with SEQ ID NO:241;

(viii) a polypeptide having activity as encoded for by the open reading frame YJL064w comprising an amino acid sequence having at least about 30% sequence identity with SEQ ID NO: 243; or (ix) a polypeptide having activity as encoded for by the open reading frame YJL062w comprising an amino acid sequence having at least about 30% sequence identity with SEQ ID NO: 245.

The invention further relates to a recombinant microorganism of the invention, wherein said recombinant microorganism has been modified in its genome in at least one position of one or more of (i) a nucleic acid encoding a phosphatase capable of acting on geranylgeranylpyrophosphate (GGPP) resulting in the formation of geranylgeraniol (GOH) which comprises a nucleic acid sequence having at least about 60% sequence identity with SEQ ID NO: 224;

(ii) a nucleic acid encoding a phosphatase capable of acting on farnesylpyrophosphate (FPP) resulting in the formation of farnesol and nerolidol which comprises a nucleic acid sequence having at least about 60% sequence identity with SEQ ID NO: 226;

(iii) a nucleic acid encoding an exo-1,3-β glucanase which comprises a nucleic acid sequence having at least about 60% sequence identity with SEQ ID NO: 228 or 230;

(iv) a nucleic acid encoding a glycogen synthase (or a polypeptide that influences glycogen accumulation) which comprises a nucleic acid sequence having at least about 60% sequence identity with SEQ ID NO: 232, 234 or 249;

(v) a nucleic acid encoding a transcriptional repressor of hypoxic genes which comprises a nucleic acid sequence having at least about 60% sequence identity with SEQ ID NO:236;

(vi) a nucleic acid encoding an NADPH oxidase which comprises a nucleic acid sequence having at least about 60% sequence identity with SEQ ID NO: 238;

(vii) a nucleic acid encoding a monocarboxylate transporter which comprises a nucleic acid sequence having at least about 60% sequence identity with SEQ ID NO: 240;

(viii) a nucleic acid encoding polypeptide having activity as encoded for by the open reading frame YJL064w comprising an amino acid sequence having at least about 60% sequence identity with SEQ ID NO: 242; or (ix) a nucleic acid encoding a polypeptide having activity as encoded for by the open reading frame YJL062w comprising an amino acid sequence having at least about 60% sequence identity with SEQ ID NO: 244.

A microorganism may have one or two or more of such modifications.

The invention also provides a recombinant microorganism of the invention, wherein the microorganism comprises one or more nucleotide sequence(s) encoding one or more polypeptides having UDP-glucosyltransferase activity (UGT), whereby expression of the nucleotide sequence confers on the microorganism the ability to produce at least one of steviolmonoside, steviolbioside, stevioside, rebaudioside A, rebaudioside B, rebaudioside C, rebaudioside D, rebaudioside E, rebaudioside F, rubusoside or dulcoside A.

The invention also provides:

a process for the preparation of a diterpene or glycosylated diterpene which comprises fermenting a recombinant microorganism of the invention in a suitable fermentation medium, and optionally recovering the diterpene or glycosylated diterpene;

a process for the preparation of a diterpene or glycosylated diterpene which process comprises fermenting a recombinant microorganism capable of producing a diterpene or glycosylate diterpene in a suitable fermentation medium at a temperature of about 29° C. or less, and optionally recovering the diterpene or glycosylated diterpene;

a fermentation broth comprising a diterpene or glycosylated diterpene obtainable by the process of the invention;

a diterpene or glycosylated diterpene obtained by a process according to the invention or obtainable from a fermentation broth according to the invention;

a diterpene or glycosylated diterpene according to the invention which is rebaudioside A or rebaudioside D; and a foodstuff, feed or beverage which comprises a diterpene or glycosylated diterpene according to the invention.

Also provided by the invention is a method for converting a first glycosylated diterpene into a second glycosylated diterpene, which method comprises:

contacting said first glycosylated diterpene with a microorganism according to the invention, a cell free extract derived from such a microorganism or an enzyme preparation derived from either thereof, thereby to convert the first glycosylated diterpene into the second glycosylated diterpene.

BRIEF DESCRIPTION OF THE DRAWINGS

The patent or application file contains at least one drawing executed in color. Copies of this patent or patent application publication with the color drawing(s) will be provided by the Office upon request and payment of the necessary fee.

DESCRIPTION OF THE SEQUENCE LISTING

Figure 1:
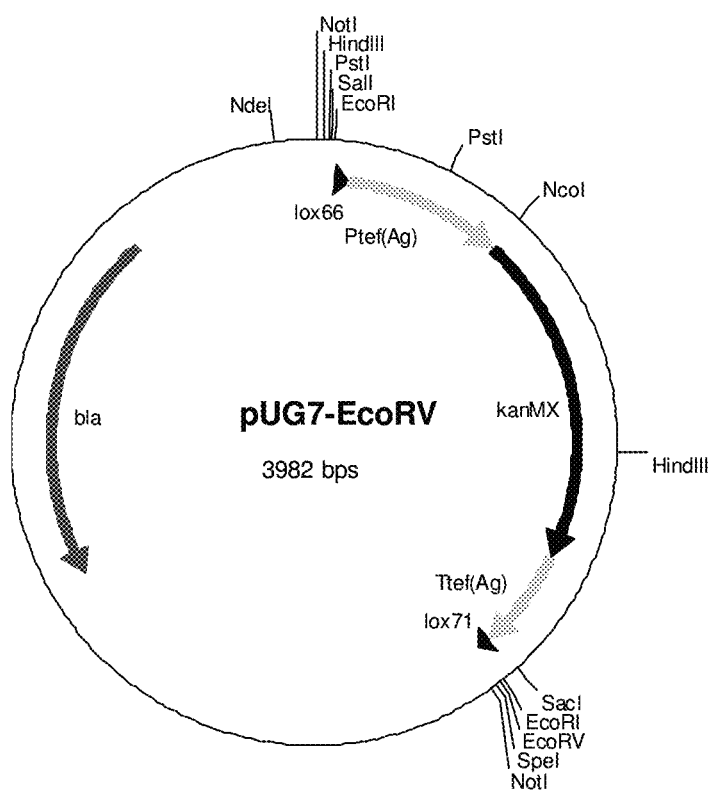
FIG. 1 sets out a schematic representation of the plasmid pUG7-EcoRV.

A description of the sequences is set out in Table 1. Sequences described herein may be defined with reference to the sequence listing or with reference to the database accession numbers also set out in Table 1.

DETAILED DESCRIPTION OF A PREFERRED EMBODIMENT

Throughout the present specification and the accompanying claims, the words "comprise", "include" and "having" and variations such as "comprises", "comprising", "includes" and "including" are to be interpreted inclusively. That is, these words are intended to convey the possible inclusion of other elements or integers not specifically recited, where the context allows.

The articles "a" and "an" are used herein to refer to one or to more than one (i.e. to one or at least one) of the grammatical object of the article. By way of example, "an element" may mean one element or more than one element.

The invention relates to a recombinant microorganism that is capable of producing a diterpene or a glycosylated diterpene, typically steviol or a steviol glycoside respectively. For the purposes of this invention, a diterpene typically means an organic compound composed of four isoprene units. Such a compound may be derived from geranylgeranyl pyrophosphate. A glycosylated diterpene or diterpene glycoside is a diterpene in which a sugar is bound, typically to a non-carbohydrate moiety. Typically, in a diterpene glycoside, the sugar group may be bonded through its anomeric carbon to another group via a glycosidic bond. A preferred diterpene and diterpene glycoside is steviol and steviol glycoside respectively. Thus, in particular, the invention relates to a recombinant microorganism which is capable of producing steviol or a steviol glycoside.

According to the invention, there is provided a recombinant microorganism. The recombinant microorganism comprises one or more nucleotide sequence(s) encoding:
  a polypeptide having ent-copalyl pyrophosphate synthase activity;
  a polypeptide having ent-Kaurene synthase activity;
  a polypeptide having ent-Kaurene oxidase activity; and
  a polypeptide having kaurenoic acid 13-hydroxylase activity,
whereby expression of the nucleotide sequence(s) confer(s) on the microorganism the ability to produce at least steviol.

Critically, said recombinant microorganism is modified in its genome such that it results in a deficiency in the production of one or more of:
  (i) a phosphatase capable of acting on geranylgeranylpyrophosphate (GGPP) resulting in the formation of geranylgeraniol (GOH);
  (ii) a phosphatase capable of acting on farnesylpyrophosphate (FPP) resulting in the formation of farnesol and nerolidol;
  (iii) an exo-1,3-β glucanase;
  (iv) a glycogen synthase (or a polypeptide that influences glycogen accumulation);
  (v) a transcriptional repressor of hypoxic genes (ROX1)
  (vi) an NADPH oxidase; or
  (vii) a monocarboxylate transporter (JEN1)
  (viii) a polypeptide having the activity encoded for by the open reading frame, YJL064w; or
  (ix) a polypeptide having the activity encoded for by open reading frame, YPL062w.

A deficiency in production of one or more of the above leads to higher production of a diterpene or diterpene glycoside as compared with a recombinant microorganism which does not have the said deficiency in production.

A phosphatase capable of acting on geranylgeranylpyrophosphate (GGPP) resulting in the formation of geranylgeraniol (GOH) may be any polypeptide which has that said activity, for example a diacylglycerol pyrophosphate phosphatase, such as that encoded by DPP1 (YDR284C).

A phosphatase capable of acting on farnesylpyrophosphate (FPP) resulting in the formation of farnesol and nerolidol may be any polypeptide which has that said activity, for example a lipid phosphate phosphatase, such as that encoded by the LPP1 gene (YDR503C).

An exo-1,3-β-glucanase may be any polypeptide which has that said activity, for example that encoded by the EXG1 (YLR300W) or EXG2 (YDR261C) genes.

A glycogen synthase (or a polypeptide that influences glycogen accumulation) may be any polypeptide which has that said activity, for example that encoded by the GSY1 (YFR0150 or YALI0F18502) or GSY2 (YLR258W) genes.

A transcriptional repressor of hypoxic genes may be any polypeptide which has that said activity, for example that encoded by the ROX1 gene (YPR065W).

An NADPH oxidase may be any polypeptide which has that said activity, for example that encoded by the YNO1 (YGL160W) gene.

A monocarboxylate transporter may be any polypeptide which has that said activity, for example that encoded by the JEN1 gene.

A polypeptide having the activity encoded by the open reading frame YJL064w may be any polypeptide which has that said activity.

A polypeptide having the activity encoded by open reading frame YPL062w may be any polypeptide which has that said activity.

The open reading frames and genes referred to herein may be identified at the *Saccharomyces* Genome Database (www.yeastgenome.com).

The invention also relates to such a recombinant microorganism, wherein said recombinant microorganism has been modified in its genome such that it results in a deficiency in the production of one or more of:

(i) a phosphatase capable of acting on geranylgeranylpyrophosphate (GGPP) resulting in the formation of geranylgeraniol (GOH) comprising an amino acid sequence having at least about 30% sequence identity with SEQ ID NO: 225;

(ii) a phosphatase capable of acting on farnesylpyrophosphate (FPP) resulting in the formation of farnesol and nerolidol comprising an amino acid sequence having at least about 30% sequence identity with SEQ ID NO: 227;

(iii) an exo-1,3-β glucanase comprising an amino acid sequence having at least about 30% sequence identity with SEQ ID NO: 229 or 231;

(iv) a glycogen synthase (or a polypeptide that influences glycogen accumulation) comprising an amino acid sequence having at least about 30% sequence identity with SEQ ID NO: 233, 235 or 250;

(v) a transcriptional repressor of hypoxic genes comprising an amino acid sequence having at least about 30% sequence identity with SEQ ID NO: 237;

(vi) an NADPH oxidase comprising an amino acid sequence having at least about 30% sequence identity with SEQ ID NO:239;

(vii) a monocarboxylate transporter comprising an amino acid sequence having at least about 30% sequence identity with SEQ ID NO:241;

(viii) a polypeptide having activity as encoded for by the open reading frame YJL064w comprising an amino acid sequence having at least about 30% sequence identity with SEQ ID NO: 243; or (ix) a polypeptide having activity as encoded for by the open reading frame YJL062w comprising an amino acid sequence having at least about 30% sequence identity with SEQ ID NO: 245.

The invention also relates to such a recombinant microorganism, wherein said recombinant microorganism has been modified in its genome such that it results in a deficiency in the production of one or more of:

(i) a nucleic acid encoding a phosphatase capable of acting on geranylgeranylpyrophosphate (GGPP) resulting in the formation of geranylgeraniol (GOH) which comprises a nucleic acid sequence having at least about 60% sequence identity with SEQ ID NO: 224;

(ii) a nucleic acid encoding a phosphatase capable of acting on farnesylpyrophosphate (FPP) resulting in the formation of farnesol and nerolidol which comprises a nucleic acid sequence having at least about 60% sequence identity with SEQ ID NO: 226;

(iii) a nucleic acid encoding an exo-1,3-β glucanase which comprises a nucleic acid sequence having at least about 60% sequence identity with SEQ ID NO: 228 or 230;

(iv) a nucleic acid encoding a glycogen synthase (or a polypeptide that influences glycogen accumulation) which comprises a nucleic acid sequence having at least about 60% sequence identity with SEQ ID NO: 232, 234 or 249;

(v) a nucleic acid encoding a transcriptional repressor of hypoxic genes which comprises a nucleic acid sequence having at least about 60% sequence identity with SEQ ID NO:236;

(vi) a nucleic acid encoding an NADPH oxidase which comprises a nucleic acid sequence having at least about 60% sequence identity with SEQ ID NO: 238;

(vii) a nucleic acid encoding a monocarboxylate transporter which comprises a nucleic acid sequence having at least about 60% sequence identity with SEQ ID NO: 240;

(viii) a nucleic acid encoding polypeptide having activity as encoded for by the open reading frame YJL064w comprising an amino acid sequence having at least about 60% sequence identity with SEQ ID NO: 242; or (ix) a nucleic acid encoding a polypeptide having activity as encoded for by the open reading frame YJL062w comprising an amino acid sequence having at least about 60% sequence identity with SEQ ID NO: 244.

A recombinant microorganism may comprise one, two, three, four, five, six, seven, eight or all of the modifications described above. A recombinant microorganism may comprise any combination of two or more of the modifications described above.

Deficiency of a recombinant microorganism in the production of at least one of the polypeptides referred to herein is defined as a phenotypic feature wherein the cell, due to modification in the genome: a) produces less of the polypeptide and/or b) has a reduced expression level of the mRNA transcribed from a gene encoding the polypeptide and/or c) produces a polypeptide having a decreased protein activity or decreased specific protein activity and/or d) produces less of a product produced by the polypeptide and combinations of one or more of these possibilities as compared to a recombinant microorganism that has not been modified in its genome according to the invention, when analysed under substantially identical conditions.

In this context a gene is herewith defined as a polynucleotide containing an open reading frame (ORF) together with its transcriptional control elements (promoter and terminator), the ORF being the region on the gene that will be transcribed and translated into the protein sequence.

Therefore deficiency of a microbial host cell may be measured by determining the amount and/or (specific) activity of the relevant polypeptide produced by the recombinant microorganism modified in its genome and/or it may be measured by determining the amount of mRNA transcribed from a gene encoding the polypeptide and/or it may be measured by determining the amount of a product produced by the polypeptide in a recombinant microorganism modified in its genome as defined above and/or it may be measured by gene or genome sequencing if compared to the parent host cell which has not been modified in its genome. Deficiency in the production of a polypeptide can be measured using any assay available to the skilled person, such as transcriptional profiling, Northern blotting RT-PCR, Q-PCR and Western blotting.

Modification of a genome of a recombinant microorganism is herein defined as any event resulting in a change in a polynucleotide sequence in the genome of the cell. A modification is construed as one or more modifications. Modification can be introduced by classical strain improvement, random mutagenesis followed by selection. Modification may be accomplished by the introduction (insertion), substitution or removal (deletion) of one or more nucleotides in a nucleotide sequence. This modification may for example be in a coding sequence or a regulatory element required for the transcription or translation of the polynucleotide. For example, nucleotides may be inserted or removed so as to result in the introduction of a stop codon, the removal of a start codon or a change or a frame-shift of the open reading frame of a coding sequence. The modification of a coding sequence or a regulatory element thereof may be accomplished by site-directed or random mutagenesis, DNA shuffling methods, DNA reassembly methods, gene synthesis (see for example Young and Dong, (2004), *Nucleic Acids Research* 32, (7) electronic access nar.oupjournals.org/cgi/reprint/32/7/e59 or Gupta et al. (1968), *Proc. Natl. Acad. Sci USA*, 60: 1338-1344; Scarpulla et al. (1982), *Anal. Biochem.* 121: 356-365; Stemmer et al. (1995), *Gene* 164: 49-53), or PCR generated mutagenesis in accordance with methods known in the art. Examples of random mutagenesis procedures are well known in the art, such as for example chemical (NTG for example) mutagenesis or physical (UV for example) mutagenesis. Examples of directed mutagenesis procedures are the QuickChange™ site-directed mutagenesis kit (Stratagene Cloning Systems, La Jolla, Calif.), the 'The Altered Sites® II in vitro Mutagenesis Systems' (Promega Corporation) or by overlap extension using PCR as described in Gene. 1989 Apr. 15; 77(1):51-9. (Ho S N, Hunt H D, Horton R M, Pullen J K, Pease L R "Site-directed mutagenesis by overlap extension using the polymerase chain reaction") or using PCR as described in *Molecular Biology: Current Innovations and Future Trends*. (Eds. A. M. Griffin and H. G. Griffin. ISBN 1-898486-01-8; 1995 Horizon Scientific Press, PO Box 1, Wymondham, Norfolk, U.K.).

A modification in the genome can be determined by comparing the DNA sequence of the modified cell to the sequence of the non-modified cell. Sequencing of DNA and genome sequencing can be done using standard methods known to the person skilled in the art, for example using Sanger sequencing technology and/or next generation sequencing technologies such as Illumina GA2, Roche 454, etc. as reviewed in Elaine R. Mardis (2008), Next-Generation DNA Sequencing Methods, Annual Review of Genomics and Human Genetics, 9: 387-402. (doi:10.1146/annurev.genom.9.081307.164359).

Preferred methods of modification are based on techniques of gene replacement, gene deletion, or gene disruption.

For example, in case of replacement of a polynucleotide, nucleic acid construct or expression cassette, an appropriate DNA sequence may be introduced at the target locus to be replaced. The appropriate DNA sequence is preferably present on a cloning vector. Preferred integrative cloning vectors comprise a DNA fragment, which is homologous to the polynucleotide and/or has homology to the polynucleotides flanking the locus to be replaced for targeting the integration of the cloning vector to this pre-determined locus. In order to promote targeted integration, the cloning vector is preferably linearized prior to transformation of the cell. Preferably, linearization is performed such that at least one but preferably either end of the cloning vector is flanked by sequences homologous to the DNA sequence (or flanking sequences) to be replaced. This process is called homologous recombination and this technique may also be used in order to achieve (partial) gene deletion or gene disruption.

For example, for gene disruption, a polynucleotide corresponding to the endogenous polynucleotide may be replaced by a defective polynucleotide, that is a polynucleotide that fails to produce a (fully functional) protein. By homologous recombination, the defective polynucleotide replaces the endogenous polynucleotide. It may be desirable that the defective polynucleotide also encodes a marker, which may be used for selection of transformants in which the nucleic acid sequence has been modified.

Alternatively, modification, wherein said host cell produces less of or is deficient in the production of one of the polypeptides described herein may be performed by established anti-sense techniques using a nucleotide sequence complementary to the nucleic acid sequence of the polynucleotide. More specifically, expression of the polynucleotide by a host cell may be reduced or eliminated by introducing a nucleotide sequence complementary to the nucleic acid sequence of the polynucleotide, which may be transcribed in the cell and is capable of hybridizing to the mRNA produced in the cell. Under conditions allowing the complementary anti-sense nucleotide sequence to hybridize to the mRNA, the amount of protein translated is thus reduced or eliminated. An example of expressing an anti-sense-RNA is shown in Appl. Environ. Microbiol. 2000 February; 66(2):775-82. (*Characterization of a foldase, protein disulfide isomerase A, in the protein secretory pathway of Aspergillus niger.* Ngiam C, Jeenes D J, Punt P J, Van Den Hondel C A, Archer D B) or (Zrenner R, Willmitzer L, Sonnewald U. *Analysis of the expression of potato uridinediphosphate-glucose pyrophosphorylase and its inhibition by antisense RNA. Planta.* (1993); 190(2):247-52.).

Furthermore, modification, downregulation or inactivation of a polynucleotide may be obtained via the RNA interference (RNAi) technique (FEMS Microb. Lett. 237 (2004): 317-324). In this method identical sense and anti-sense parts of the nucleotide sequence, which expression is to be affected, are cloned behind each other with a nucleotide spacer in between, and inserted into an expression vector. After such a molecule is transcribed, formation of small nucleotide fragments will lead to a targeted degradation of the mRNA, which is to be affected. The elimination of the specific mRNA can be to various extents. The RNA interference techniques described in WO2008/053019, WO2005/05672A1, WO2005/026356A1, Oliveira et al., "*Efficient cloning system for construction of gene silencing vectors in Aspergillus niger*" (2008) *Appl. Microbiol. and Biotechnol.* 80 (5): 917-924 and/or Barnes et al., "*siRNA as a molecular tool for use in Aspergillus niger*" (2008) *Biotechnology Letters* 30 (5): 885-890 may be used for downregulation, modification or inactivation of a polynucleotide.

Preferably, in a recombinant microorganism according to the invention, the deficiency in the production of one or more of the polypeptides identified herein is a reduction in production of at least 20% more preferably by at least 30%, more preferably by at least 40%, even more preferably at least 50%, even more preferably at least 60%, in particular at least 70%, more in particular at least 80%, for example at least 85%, for example at least 90%, for example at least 95%, for example at least 100% (as compared to a recombinant microorganism that has not been modified in its genome according to the invention, when analysed under substantially identical conditions).

Preferably, the modification in the genome of the microbial host cell according to the invention is a modification in the genome on at least one position of at least one nucleic acid sequence encoding a polypeptide having at least 35% identity, more preferably at least 40% identity, more preferably at least 45% identity, more preferably at least 50% identity, even more preferably at least 55% identity, even more preferably at least 60% identity, even more preferably at least 65% identity, even more preferably at least 70% identity, even more preferably at least 75% identity, even more preferably at least 80% identity, even more preferably at least 85% identity, even more preferably at least 90% identity, for example at least 91% identity, for example at least 92% identity, for example at least 93% identity, for example at least 94% identity, for example at least 95% identity, for example at least 96% identity, for example at least 97% identity, for example at least 98% identity, for example at least 99% identity, for example 100% identity with a polypeptide selected from a polypeptide according to SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244 or 249 and/or the modification in the genome of the microbial host cell in the method according to the invention is a modification resulting in the reduction of the amount of at least one mRNA having at least 60% identity, even more preferably at least 65% identity, even more preferably at least 70% identity, even more preferably at least 75% identity, even more preferably at least 80% identity, even more preferably at least 85% identity, even more preferably at least 90% identity, for example at least 91% identity, for example at least 92% identity, for example at least 93% identity, for example at least 94% identity, for example at least 95% identity, for example at least 96% identity, for example at least 97% identity, for example at least 98% identity, for example at least 99% identity, for example 100% identity with an mRNA selected from the group of the mRNA according to SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245 or 250.

In each case, the modification typically takes place in an mRNA sequence or a nucleic acid sequence encoding polypeptide encoding or having the same activity as the given SEQ ID NO.

For the purposes of this invention, a polypeptide having ent-copalyl pyrophosphate synthase (EC 5.5.1.13) is capable of catalyzing the chemical reaction:

Hence, this enzyme has one substrate, ent-copalyl diphosphate, and two products, ent-kaurene and diphosphate.

This enzyme belongs to the family of lyases, specifically those carbon-oxygen lyases acting on phosphates. The systematic name of this enzyme class is ent-copalyl-diphosphate diphosphate-lyase (cyclizing, ent-kaurene-forming). Other names in common use include ent-kaurene synthase B, ent-kaurene synthetase B, ent-copalyl-diphosphate diphosphate-lyase, and (cyclizing). This enzyme participates in diterpenoid biosynthesis.

ent-copalyl diphosphate synthases may also have a distinct ent-kaurene synthase activity associated with the same protein molecule. The reaction catalyzed by ent-kaurene synthase is the next step in the biosynthetic pathway to gibberellins. The two types of enzymic activity are distinct, and site-directed mutagenesis to suppress the ent-kaurene synthase activity of the protein leads to build up of ent-copalyl pyrophosphate.

Accordingly, a single nucleotide sequence used in the invention may encode a polypeptide having ent-copalyl pyrophosphate synthase activity and ent-kaurene synthase activity. Alternatively, the two activities may be encoded two distinct, separate nucleotide sequences.

For the purposes of this invention, a polypeptide having ent-kaurene oxidase activity (EC 1.14.13.78) is a polypeptide which is capable of catalysing three successive oxidations of the 4-methyl group of ent-kaurene to give kaurenoic acid. Such activity typically requires the presence of a cytochrome P450.

For the purposes of the invention, a polypeptide having kaurenoic acid 13-hydroxylase activity (EC 1.14.13) is one which is capable of catalyzing the formation of steviol (ent-kaur-16-en-13-01-19-oic acid) using NADPH and 02. Such activity may also be referred to as ent-ka 13-hydroxylase activity.

A recombinant microorganism of the invention may comprise one or more nucleotide sequences encoding a poly-

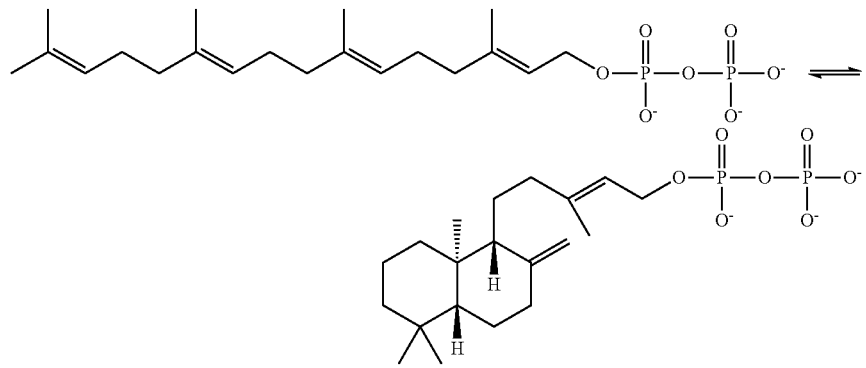

This enzyme has one substrate, geranylgeranyl pyrophosphate, and one product, ent-copalyl pyrophosphate. This enzyme participates in gibberellin biosynthesis. This enzyme belongs to the family of isomerase, specifically the class of intramolecular lyases. The systematic name of this enzyme class is ent-copalyl-diphosphate lyase (decyclizing). Other names in common use include having ent-copalyl pyrophosphate synthase, ent-kaurene synthase A, and ent-kaurene synthetase A.

For the purposes of this invention, a polypeptide having ent-kaurene synthase activity (EC 4.2.3.19) is a polypeptide that is capable of catalyzing the chemical reaction:

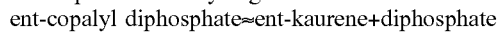

peptide having UDP-glucosyltransferase (UGT) activity, whereby expression of the nucleotide sequence(s) confer(s) on the microorganism the ability to produce at least one of steviolmonoside, steviolbioside, stevioside or rebaudioside A, rebaudioside B, rebaudioside C, rebaudioside D, rebaudioside E, rebaudioside F, rubusoside, dulcoside A.

For the purposes of this invention, a polypeptide having UGT activity is one which has glycosyltransferase activity (EC 2.4), i.e. that can act as a catalyst for the transfer of a monosaccharide unit from an activated nucleotide sugar (also known as the "glycosyl donor") to a glycosyl acceptor molecule, usually an alcohol. The glycosyl donor for a UGT is typically the nucleotide sugar uridine diphosphate glucose (uracil-diphosphate glucose, UDP-glucose).

Figure 7:
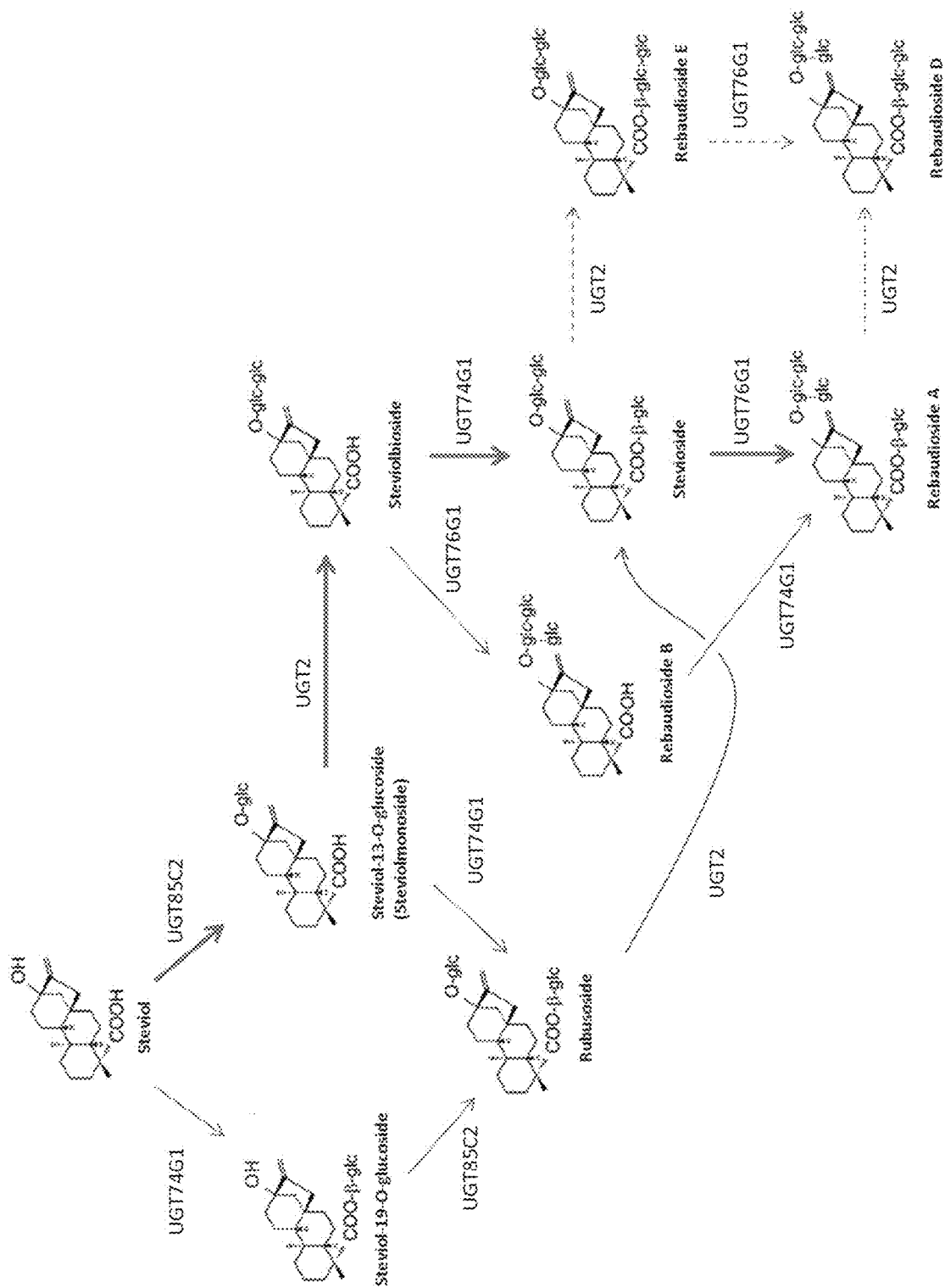

The UGTs used may be selected so as to produce a desired diterpene glycoside, such as a steviol glycoside. Schematic diagrams of steviol glycoside formation are set out in Humphrey et al., Plant Molecular Biology (2006) 61: 47-62 and Mohamed et al., J. Plant Physiology 168 (2011) 1136-1141. In addition, FIG. 7 sets out a schematic diagram of steviol glycoside formation.

The biosynthesis of rebaudioside A involves glucosylation of the aglycone steviol. Specifically, rebaudioside A can be formed by glucosylation of the 13-OH of steviol which forms the 13-O-steviolmonoside, glucosylation of the C-2' of the 13-O-glucose of steviolmonoside which forms steviol-1,2-bioside, glucosylation of the C-19 carboxyl of steviol-1,2-bioside which forms stevioside, and glucosylation of the C-3' of the C-13-O-glucose of stevioside. The order in which each glucosylation reaction occurs can vary—see FIG. 7. One UGT may be capable of catalyzing more than one conversion as set out in this scheme.

We have shown that conversion of steviol to rebaudioside A or rebaudioside D may be accomplished in a recombinant host by the expression of gene(s) encoding the following functional UGTs: UGT74G1, UGT85C2, UGT76G1 and UGT2. Thus, a recombinant microorganism expressing these four UGTs can make rebaudioside A if it produces steviol or when fed steviol in the medium. Typically, one or more of these genes are recombinant genes that have been transformed into a microorganism that does not naturally possess them. Examples of all of these enzymes are set out in Table 1. A microorganism of the invention may comprise any combination of a UGT74G1, UGT85C2, UGT76G1 and UGT2. In Table 1 UGT64G1 sequences are indicated as UGT1 sequences, UGT74G1 sequences are indicated as UGT3 sequences and UGT76G1 sequences are indicated as UGT4 sequences. UGT2 sequences are indicated as UGT2 sequences in Table 1.

A recombinant microorganism of the invention which comprises a nucleotide sequence encoding a polypeptide having UGT activity may comprise a nucleotide sequence encoding a polypeptide capable of catalyzing the addition of a C-13-glucose to steviol. That is to say, a microorganism of the invention may comprise a UGT which is capable of catalyzing a reaction in which steviol is converted to steviolmonoside. Accordingly, expression of such a nucleotide sequence may confer on the microorganism the ability to produce at least steviolmonoside.

Such a microorganism of the invention may comprise a nucleotide sequence encoding a polypeptide having the activity shown by UDP-glycosyltransferase (UGT) UGT85C2, whereby the nucleotide sequence upon transformation of the microorganism confers on the cell the ability to convert steviol to steviolmonoside.

UGT85C2 activity is transfer of a glucose unit to the 13-OH of steviol. Thus, a suitable UGT85C2 may function as a uridine 5'-diphospho glucosyl: steviol 13-OH transferase, and a uridine 5'-diphospho glucosyl: steviol-19-0-glucoside 13-OH transferase. A functional UGT85C2 polypeptides may also catalyze glucosyl transferase reactions that utilize steviol glycoside substrates other than steviol and steviol-19-O-glucoside. Such sequences are indicated as UGT1 sequences in Table 1.

A recombinant microorganism of the invention which comprises a nucleotide sequence encoding a polypeptide having UGT activity may comprise a nucleotide sequence encoding a polypeptide capable of catalyzing the addition of a C-13-glucose to steviol or steviolmonoside. That is to say, a microorganism of the invention may comprise a UGT which is capable of catalyzing a reaction in which steviolmonoside is converted to steviolbioside. Accordingly, such a microorganism may be capable of converting steviolmonoside to steviolbioside. Expression of such a nucleotide sequence may confer on the microorganism the ability to produce at least steviolbioside.

A microorganism of the invention may also comprise a nucleotide sequence encoding a polypeptide having the activity shown by UDP-glycosyltransferase (UGT) UGT74G1, whereby the nucleotide sequence upon transformation of the microorganism confers on the cell the ability to convert steviolmonoside to steviolbioside.

A microorganism of the invention may also comprise a nucleotide sequence encoding a polypeptide having the activity shown by UDP-glycosyltransferase (UGT) UGT2, whereby the nucleotide sequence upon transformation of the microorganism confers on the cell the ability to convert steviolmonoside to steviolbioside.

A suitable UGT2 polypeptide functions as a uridine 5'-diphospho glucosyl: steviol-13-O-glucoside transferase (also referred to as a steviol-13-monoglucoside 1,2-glucosylase), transferring a glucose moiety to the C-2' of the 13-O-glucose of the acceptor molecule, steviol-13-O-glucoside. Typically, a suitable UGT2 polypeptide also functions as a uridine 5'-diphospho glucosyl: rubusoside transferase transferring a glucose moiety to the C-2' of the 13-O-glucose of the acceptor molecule, rubusoside.

Functional UGT2 polypeptides may also catalyze reactions that utilize steviol glycoside substrates other than steviol-13-O-glucoside and rubusoside, e.g., functional UGT2 polypeptides may utilize stevioside as a substrate, transferring a glucose moiety to the C-2' of the 19-O-glucose residue to produce Rebaudioside E. A functional UGT2 polypeptides may also utilize Rebaudioside A as a substrate, transferring a glucose moiety to the C-2' of the 19-O-glucose residue to produce Rebaudioside D. However, a functional UGT2 polypeptide typically does not transfer a glucose moiety to steviol compounds having a 1,3-bound glucose at the C-13 position, i.e., transfer of a glucose moiety to steviol 1,3-bioside and 1,3-stevioside does not occur.

Functional UGT2 polypeptides may also transfer sugar moieties from donors other than uridine diphosphate glucose. For example, a functional UGT2 polypeptide may act as a uridine 5'-diphospho D-xylosyl: steviol-13-O-glucoside transferase, transferring a xylose moiety to the C-2' of the 13-O-glucose of the acceptor molecule, steviol-13-O-glucoside. As another example, a functional UGT2 polypeptide can act as a uridine 5'-diphospho L-rhamnosyl: steviol-13-O-glucoside transferase, transferring a rhamnose moiety to the C-2' of the 13-O-glucose of the acceptor molecule, steviol-13-O-glucoside. Such sequences are indicated as UGT2 sequences in Table 1.

A recombinant microorganism of the invention which comprises a nucleotide sequence encoding a polypeptide having UGT activity may comprise a nucleotide sequence encoding a polypeptide capable of catalyzing the addition of a C-19-glucose to steviolbioside. That is to say, a microorganism of the invention may comprise a UGT which is capable of catalyzing a reaction in which steviolbioside is converted to stevioside. Accordingly, such a microorganism may be capable of converting steviolbioside to stevioside. Expression of such a nucleotide sequence may confer on the microorganism the ability to produce at least stevioside.

A microorganism of the invention may also comprise a nucleotide sequence encoding a polypeptide having the activity shown by UDP-glycosyltransferase (UGT)

UGT74G1, whereby the nucleotide sequence upon transformation of the microorganism confers on the cell the ability to convert steviolbioside to stevioside.

Suitable UGT74G1 polypeptides may be capable of transferring a glucose unit to the 13-OH or the 19-COOH, respectively, of steviol. A suitable UGT74G1 polypeptide may function as a uridine 5'-diphospho glucosyl: steviol 19-COOH transferase and a uridine 5'-diphospho glucosyl: steviol-13-O-glucoside 19-COOH transferase. Functional UGT74G1 polypeptides also may catalyze glycosyl transferase reactions that utilize steviol glycoside substrates other than steviol and steviol-13-O-glucoside, or that transfer sugar moieties from donors other than uridine diphosphate glucose. Such sequences are indicated as UGT1 sequences in Table 3.

A recombinant microorganism of the invention which comprises a nucleotide sequence encoding a polypeptide having UGT activity may comprise a nucleotide sequence encoding a polypeptide capable of catalyzing glucosylation of the C-3' of the glucose at the C-13 position of stevioside. That is to say, a microorganism of the invention may comprise a UGT which is capable of catalyzing a reaction in which stevioside to rebaudioside A. Accordingly, such a microorganism may be capable of converting stevioside to rebaudioside A. Expression of such a nucleotide sequence may confer on the microorganism the ability to produce at least rebaudioside A.

A microorganism of the invention may also comprise a nucleotide sequence encoding a polypeptide having the activity shown by UDP-glycosyltransferase (UGT) UGT76G1, whereby the nucleotide sequence upon transformation of the microorganism confers on the cell the ability to convert stevioside to rebaudioside A.

A suitable UGT76G1 adds a glucose moiety to the C-3' of the C-13-O-glucose of the acceptor molecule, a steviol 1,2 glycoside. Thus, UGT76G1 functions, for example, as a uridine 5'-diphospho glucosyl: steviol 13-0-1,2 glucoside C-3 ' glucosyl transferase and a uridine 5'-diphospho glucosyl: steviol-19-0-glucose, 13-0-1,2 bioside C-3' glucosyl transferase. Functional UGT76G1 polypeptides may also catalyze glucosyl transferase reactions that utilize steviol glycoside substrates that contain sugars other than glucose, e.g., steviol rhamnosides and steviol xylosides. Such sequences are indicated as UGT4 sequences in Table 1.

A microorganism of the invention may comprise nucleotide sequences encoding polypeptides having one or more of the four UGT activities described above. Preferably, a microorganism of the invention may comprise nucleotide sequences encoding polypeptides having all four of the UGT activities described above. A given nucleic acid may encode a polypeptide having one or more of the above activities. For example, a nucleic acid encode for a polypeptide which has two, three or four of the activities set out above. Preferably, a recombinant microorganism of the invention comprises UGT1, UGT2 and UGT3 activity. More preferably, such a recombinant microorganism will also comprise UGT4 activity.

A microorganism of the invention which comprises a nucleotide sequence encoding a polypeptide having UGT activity may comprise a nucleotide sequence encoding a polypeptide capable of catalyzing the glucosylation of stevioside or rebaudioside A. That is to say, a microorganism of the invention may comprise a UGT which is capable of catalyzing a reaction in which stevioside or rebaudioside A is converted to rebaudioside D. Accordingly, such a microorganism may be capable of converting stevioside or rebaudioside A to rebaudioside D. Expression of such a nucleotide sequence may confer on the microorganism the ability to produce at least rebaudioside D. We have shown that a microorganism expression a combination of UGT85C2, UGT2, UGT74G1 and UGT76G1 polypeptides may be capable of rebaudioside D production.

A microorganism of the invention which comprises a nucleotide sequence encoding a polypeptide having UGT activity may comprise a nucleotide sequence encoding a polypeptide capable of catalyzing the glucosylation of stevioside. That is to say, a microorganism of the invention may comprise a UGT which is capable of catalyzing a reaction in which stevioside is converted to rebaudioside E. Accordingly, such a microorganism may be capable of converting stevioside to rebaudioside E. Expression of such a nucleotide sequence may confer on the microorganism the ability to produce at least rebaudioside E.

A microorganism of the invention which comprises a nucleotide sequence encoding a polypeptide having UGT activity may comprise a nucleotide sequence encoding a polypeptide capable of catalyzing the glucosylation of rebaudioside E. That is to say, a microorganism of the invention may comprise a UGT which is capable of catalyzing a reaction in which rebaudioside E is converted to rebaudioside D. Accordingly, such a microorganism may be capable of converting stevioside or rebaudioside A to rebaudioside D. Expression of such a nucleotide sequence may confer on the microorganism the ability to produce at least rebaudioside D.

A recombinant microorganism of the invention may be capable of expressing a nucleotide sequence encoding a polypeptide having NADPH-cytochrome p450 reductase activity. That is to say, a recombinant microorganism of the invention may comprise sequence encoding a polypeptide having NADPH-cytochrome p450 reductase activity.

For the purposes of the invention, a polypeptide having NADPH-Cytochrome P450 reductase activity (EC 1.6.2.4; also known as NADPH:ferrihemoprotein oxidoreductase, NADPH:hemoprotein oxidoreductase, NADPH:P450 oxidoreductase, P450 reductase, POR, CPR, CYPOR) is typically one which is a membrane-bound enzyme allowing electron transfer to cytochrome P450 in the microsome of the eukaryotic cell from a FAD- and FMN-containing enzyme NADPH:cytochrome P450 reductase (POR; EC 1.6.2.4).

Preferably, a recombinant microorganism according to any one of the preceding claims, which is capable of expressing one or more of:
  a. a nucleotide sequence encoding a polypeptide having NADPH-cytochrome p450 reductase activity, wherein said nucleotide sequence comprises:
    i. a nucleotide sequence encoding a polypeptide having NADPH-cytochrome p450 reductase activity, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 54, 56, 58 or 78;
    ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 53, 55, 57 or 77;
    iii. a nucleotide sequence the complementary strand of which hybridizes to a nucleic acid molecule of sequence of (i) or (ii); or iv. a nucleotide sequence which differs from the sequence of a nucleic acid molecule of (i), (ii) or (iii) due to the degeneracy of the genetic code, Preferably, a recombinant microorganism of the invention is one which is capable of expressing one or more of:
a. a nucleotide sequence encoding a polypeptide having ent-copalyl pyrophosphate synthase activity, wherein said nucleotide sequence comprises:
  i. a nucleotide sequence encoding a polypeptide having ent-copalyl pyrophosphate synthase activity, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 2, 4, 6, 8, 18, 20, 60 or 62;
  ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 1, 3, 5, 7, 17, 19, 59 or 61, 141, 142, 151, 152, 153, 154, 159, 160, 182 or 184;
  iii. a nucleotide sequence the complementary strand of which hybridizes to a nucleic acid molecule of sequence of (i) or (ii); or
  iv. a nucleotide sequence which differs from the sequence of a nucleic acid molecule of (i), (ii) or (iii) due to the degeneracy of the genetic code,
b. a nucleotide sequence encoding a polypeptide having ent-Kaurene synthase activity, wherein said nucleotide sequence comprises:
  i. a nucleotide sequence encoding a polypeptide having ent-Kaurene synthase activity, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 10, 12, 14, 16, 18, 20, 64 or 66;
  ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 9, 11, 13, 15, 17, 19, 63, 65, 143, 144, 155, 156, 157, 158, 159, 160, 183 or 184;
  iii. a nucleotide sequence the complementary strand of which hybridizes to a nucleic acid molecule of sequence of (i) or (ii); or
  iv. a nucleotide sequence which differs from the sequence of a nucleic acid molecule of (i), (ii) or (iii) due to the degeneracy of the genetic code,
c. a nucleotide sequence encoding a polypeptide having ent-Kaurene oxidase activity, wherein said nucleotide sequence comprises:
  i. a nucleotide sequence encoding a polypeptide having ent-Kaurene oxidase activity, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 22, 24, 26, 68 or 86;
  ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 21, 23, 25, 67, 85, 145, 161, 162, 163, 180 or 186;
  iii. a nucleotide sequence the complementary strand of which hybridizes to a nucleic acid molecule of sequence of (i) or (ii); or
  iv. a nucleotide sequence which differs from the sequence of a nucleic acid molecule of (i), (ii) or (iii) due to the degeneracy of the genetic code; or
d. a nucleotide sequence encoding a polypeptide having kaurenoic acid 13-hydroxylase activity, wherein said nucleotide sequence comprises:
  i. a nucleotide sequence encoding a polypeptide having kaurenoic acid 13-hydroxylase activity, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 28, 30, 32, 34, 70, 90, 92, 94, 96 or 98;
  ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 27, 29, 31, 33, 69, 89, 91, 93, 95, 97, 146, 164, 165, 166, 167 or 185;
  iii. a nucleotide sequence the complementary strand of which hybridizes to a nucleic acid molecule of sequence of (i) or (ii); or
  iv. a nucleotide sequence which differs from the sequence of a nucleic acid molecule of (i), (ii) or (iii) due to the degeneracy of the genetic code.

In a recombinant microorganism of the invention, which is capable of expressing a nucleotide sequence encoding a polypeptide capable of catalyzing the addition of a C-13-glucose to steviol, said nucleotide may comprise:
  i. a nucleotide sequence encoding a polypeptide capable of catalyzing the addition of a C-13-glucose to steviol, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 36, 38 or 72;
  ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 35, 37, 71, 147, 168, 169 or 189;
  iii. a nucleotide sequence the complementary strand of which hybridizes to a nucleic acid molecule of sequence of (i) or (ii); or
  iv. a nucleotide sequence which differs from the sequence of a nucleic acid molecule of (i), (ii) or (iii) due to the degeneracy of the genetic code.

In a recombinant microorganism of the invention, which is capable of expressing a nucleotide sequence encoding a polypeptide capable of catalyzing the addition of a glucose at the C-13 position of steviolmonoside (this typically indicates glucosylation of the C-2' of the C-13-glucose/13-O-glucose of steviolmonoside), said nucleotide sequence may comprise:
  i. a nucleotide sequence encoding a polypeptide capable of catalyzing the addition of a C-13-glucose to steviol or steviolmonoside, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 88, 100, 102, 104, 106, 108, 110 or 112;
  ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 87, 99, 101, 103, 105, 107, 109, 111, 181 or 192;
iii. a nucleotide sequence the complementary strand of which hybridizes to a nucleic acid molecule of sequence of (i) or (ii); or
iv. a nucleotide sequence which differs from the sequence of a nucleic acid molecule of (i), (ii) or (iii) due to the degeneracy of the genetic code.

In a recombinant microorganism of the invention, which is capable of expressing a nucleotide sequence encoding a polypeptide capable of catalyzing the addition of a glucose at the C-19 position of steviolbioside, said nucleotide sequence may comprise:
i. a nucleotide sequence encoding a polypeptide capable of catalyzing the addition of a glucose at the C-19 position of steviolbioside, said polypeptide comprising an amino acid sequence that has at least about 20% sequence identity with the amino acid sequence of SEQ ID NOs: 40, 42, 44, 46, 48 or 74;
ii. a nucleotide sequence that has at least about 15% sequence identity with the nucleotide sequence of SEQ ID NOs: 39, 41, 43, 45, 47, 73, 148, 170, 171, 172, 173, 174 or 190;
iii. a nucleotide sequence the complementary strand of which hybridizes to a nucleic acid molecule of sequence of (i) or (ii); or
iv. a nucleotide sequence which differs from the sequence of a nucleic acid molecule of (i), (ii) or (iii) due to the degeneracy of the genetic code.

In a recombinant microorganism of the invention, which expresses a nucleotide sequence encoding a polypeptide capable of catalyzing glucosylation of the C-3' of the glucose at the C-13 position of stevioside, said nucleotide sequence may comprise:
i. a nucleotide sequence encoding a polypeptide capable of catalyzing glucosylation of the C-3' of the glucose at the C-13 position of stevioside, said polypeptide comprising an amino acid sequence that has at least about 20%, preferably at least 25, 30, 40, 50, 55, 60, 65, 70, 75, 80, 85, 90, 95, 96, 97, 98, or 99%, sequence identity with the amino acid sequence of SEQ ID NOs: 50, 52 or 76;
ii. a nucleotide sequence that has at least about 15%, preferably at least 20, 25, 30, 40, 50, 55, 60, 65, 70, 75, 80, 85, 90, 95, 96, 97, 98, or 99%, sequence identity with the nucleotide sequence of SEQ ID NOs: 49, 51, 75, 149, 175, 176 or 191;
iii. a nucleotide sequence the complementary strand of which hybridizes to a nucleic acid molecule of sequence of (i) or (ii); or
iv. a nucleotide sequence which differs from the sequence of a nucleic acid molecule of (i), (ii) or (iii) due to the degeneracy of the genetic code.

In a recombinant microorganism of the invention, which expresses a nucleotide sequence encoding a polypeptide capable of catalysing one or more of: the glucosylation of stevioside or rebaudioside A to rebaudioside D; the glucosylation of stevioside to rebaudioside E; or the glucosylation of rebaudioside E to rebaudioside D, said nucleotide sequence may comprise:
i. a nucleotide sequence encoding a polypeptide capable of catalysing one or more of: the glucosylation of stevioside or rebaudioside A to rebaudioside D; the glucosylation of stevioside to rebaudioside E; or the glucosylation of rebaudioside E to rebaudioside D, said polypeptide comprising an amino acid sequence that has at least about 20% sequence identity with the amino acid sequence of SEQ ID NOs: 88, 100, 102, 104, 106, 108, 110, 112;
ii. a nucleotide sequence that has at least about 15% sequence identity with the nucleotide sequence of SEQ ID NOs: 87, 99, 101, 103, 105, 107, 109, 111, 181 or 192;
iii. a nucleotide sequence the complementary strand of which hybridizes to a nucleic acid molecule of sequence of (i) or (ii); or
iv. a nucleotide sequence which differs from the sequence of a nucleic acid molecule of (i), (ii) or (iii) due to the degeneracy of the genetic code.

A microorganism according to the invention, may be one in which the ability of the microorganism to produce geranylgeranyl pyrophosphate (GGPP) is upregulated. Upregulated in the context of this invention implies that the microorganism produces more GGPP than an equivalent non-transformed strain.

Accordingly, a microorganism of the invention may comprise one or more nucleotide sequence(s) encoding hydroxymethylglutaryl-CoA reductase, farnesyl-pyrophosphate synthetase and geranylgeranyl diphosphate synthase, whereby the nucleotide sequence(s) upon transformation of the microorganism confer(s) on the microorganism the ability to produce elevated levels of GGPP.

Preferably, a microorganism according to the invention is one which is capable of expressing one or more of:
a. a nucleotide sequence encoding a polypeptide having hydroxymethylglutaryl-CoA reductase activity, wherein said nucleotide sequence comprises:
i. a nucleotide sequence encoding a polypeptide having hydroxymethylglutaryl-CoA reductase activity, said polypeptide comprising an amino acid sequence that has at least about 20% sequence identity with the amino acid sequence of SEQ ID NO: 80;
ii. a nucleotide sequence that has at least about 15% sequence identity with the nucleotide sequence of SEQ ID NO: 79;
iii. a nucleotide sequence the complementary strand of which hybridizes to a nucleic acid molecule of sequence of (i) or (ii); or
iv. a nucleotide sequence which differs from the sequence of a nucleic acid molecule of (i), (ii) or (iii) due to the degeneracy of the genetic code,
b. a nucleotide sequence encoding a polypeptide having farnesyl-pyrophosphate synthetase activity, wherein said nucleotide sequence comprises:
i. a nucleotide sequence encoding a polypeptide having farnesyl-pyrophosphate synthetase activity, said polypeptide comprising an amino acid sequence that has at least about 20% sequence identity with the amino acid sequence of SEQ ID NO: 82;
ii. a nucleotide sequence that has at least about 15% sequence identity with the nucleotide sequence of SEQ ID NOs: 81;
iii. a nucleotide sequence the complementary strand of which hybridizes to a nucleic acid molecule of sequence of (i) or (ii); or
iv. a nucleotide sequence which differs from the sequence of a nucleic acid molecule of (iii) due to the degeneracy of the genetic code; or
c. a nucleotide sequence encoding a polypeptide having geranylgeranyl diphosphate synthase activity, wherein said nucleotide sequence comprises:
i. a nucleotide sequence encoding a polypeptide having geranylgeranyl diphosphate synthase activity, said polypeptide comprising an amino acid sequence that has at least about 20% sequence identity with the amino acid sequence of SEQ ID NO: 84;

ii. a nucleotide sequence that has at least about 15% sequence identity with the nucleotide sequence of SEQ ID NOs: 83;

iii. a nucleotide sequence the complementary strand of which hybridizes to a nucleic acid molecule of sequence of (i) or (ii); or iv. a nucleotide sequence which differs from the sequence of a nucleic acid molecule of (i), (ii) or (iii) due to the degeneracy of the genetic code.

The invention relates to a recombinant microorganism. A microorganism or microbe, for the purposes of this invention, is typically an organism that is not visible to the human eye (i.e. microscopic). A microorganism may be from bacteria, fungi, archaea or protists. Typically a microorganism will be a single-celled or unicellular organism.

As used herein a recombinant microorganism is defined as a microorganism which is genetically modified or transformed/transfected with one or more of the nucleotide sequences as defined herein. The presence of the one or more such nucleotide sequences alters the ability of the microorganism to produce a diterpene or diterpene glycoside, in particular steviol or steviol glycoside. A microorganism that is not transformed/transfected or genetically modified, is not a recombinant microorganism and does typically not comprise one or more of the nucleotide sequences enabling the cell to produce a diterpene or diterpene glycoside. Hence, a non-transformed/non-transfected microorganism is typically a microorganism that does not naturally produce a diterpene, although a microorganism which naturally produces a diterpene or diterpene glycoside and which has been modified according to the invention (and which thus has an altered ability to produce a diterpene/diterpene glycoside) is considered a recombinant microorganism according to the invention.

Sequence identity is herein defined as a relationship between two or more amino acid (polypeptide or protein) sequences or two or more nucleic acid (polynucleotide) sequences, as determined by comparing the sequences. Usually, sequence identities or similarities are compared over the whole length of the sequences compared. In the art, "identity" also means the degree of sequence relatedness between amino acid or nucleic acid sequences, as the case may be, as determined by the match between strings of such sequences. "Identity" and "similarity" can be readily calculated by various methods, known to those skilled in the art. Preferred methods to determine identity are designed to give the largest match between the sequences tested. Typically then, identities and similarities are calculated over the entire length of the sequences being compared. Methods to determine identity and similarity are codified in publicly available computer programs. Preferred computer program methods to determine identity and similarity between two sequences include e.g. the BestFit, BLASTP, BLASTN, and FASTA (Altschul, S. F. et al., J. Mol. Biol. 215:403-410 (1990), publicly available from NCBI and other sources (BLAST Manual, Altschul, S., et al., NCBI NLM NIH Bethesda, Md. 20894). Preferred parameters for amino acid sequences comparison using BLASTP are gap open 10.0, gap extend 0.5, Blosum 62 matrix. Preferred parameters for nucleic acid sequences comparison using BLASTP are gap open 10.0, gap extend 0.5, DNA full matrix (DNA identity matrix).

Nucleotide sequences encoding the enzymes expressed in the cell of the invention may also be defined by their capability to hybridize with the nucleotide sequences of SEQ ID NOs: 1, 3, 5, 7, 9, 11, 13, 15, 17, 19, 21, 23, 25, 27, 29, 31, 33, 35, 37, 39, 41, 43, 45, 47, 49, 51, 53, 55, 57, 59, 61, 63, 65, 67, 69, 71, 73, 75, 77, 79, 81 or 84 or any other sequence mentioned herein respectively, under moderate, or preferably under stringent hybridisation conditions. Stringent hybridisation conditions are herein defined as conditions that allow a nucleic acid sequence of at least about 25, preferably about 50 nucleotides, 75 or 100 and most preferably of about 200 or more nucleotides, to hybridise at a temperature of about 65° C. in a solution comprising about 1 M salt, preferably 6×SSC or any other solution having a comparable ionic strength, and washing at 65° C. in a solution comprising about 0.1 M salt, or less, preferably 0.2×SSC or any other solution having a comparable ionic strength. Preferably, the hybridisation is performed overnight, i.e. at least for 10 hours and preferably washing is performed for at least one hour with at least two changes of the washing solution. These conditions will usually allow the specific hybridisation of sequences having about 90% or more sequence identity.

Moderate conditions are herein defined as conditions that allow a nucleic acid sequences of at least 50 nucleotides, preferably of about 200 or more nucleotides, to hybridise at a temperature of about 45° C. in a solution comprising about 1 M salt, preferably 6×SSC or any other solution having a comparable ionic strength, and washing at room temperature in a solution comprising about 1 M salt, preferably 6×SSC or any other solution having a comparable ionic strength. Preferably, the hybridisation is performed overnight, i.e. at least for 10 hours, and preferably washing is performed for at least one hour with at least two changes of the washing solution. These conditions will usually allow the specific hybridisation of sequences having up to 50% sequence identity. The person skilled in the art will be able to modify these hybridisation conditions in order to specifically identify sequences varying in identity between 50% and 90%.

The nucleotide sequences encoding an ent-copalyl pyrophosphate synthase; ent-Kaurene synthase; ent-Kaurene oxidase; kaurenoic acid 13-hydroxylase; UGT; hydroxymethylglutaryl-CoA reductase, farnesyl-pyrophosphate synthetase; geranylgeranyl diphosphate synthase; NADPH-cytochrome p450 reductase, may be from prokaryotic or eukaryotic origin.

A nucleotide sequence encoding an ent-copalyl pyrophosphate synthase may for instance comprise a sequence as set out in SEQ ID NO: 1, 3, 5, 7, 17, 19, 59, 61, 141, 142, 151, 152, 153, 154, 159, 160, 182 or 184.

A nucleotide sequence encoding an ent-Kaurene synthase may for instance comprise a sequence as set out in SEQ ID NO: 9, 11, 13, 15, 17, 19, 63, 65, 143, 144, 155, 156, 157, 158, 159, 160, 183 or 184.

A nucleotide sequence encoding an ent-Kaurene oxidase may for instance comprise a sequence as set out in SEQ ID NO: 21, 23, 25, 67, 85, 145, 161, 162, 163, 180 or 186. A preferred KO is the polypeptide encoded by the nucleic acid set out in SEQ ID NO: 85.

A nucleotide sequence encoding a kaurenoic acid 13-hydroxylase may for instance comprise a sequence as set out in SEQ ID NO: 27, 29, 31, 33, 69, 89, 91, 93, 95, 97, 146, 164, 165, 166, 167 or 185. A preferred KAH sequence is the polypeptide encoded by the nucleic acid set out in SEQ ID NO: 33.

A further preferred recombinant microorganism of the invention may express a combination of the polypeptides encoded by SEQ ID NO: 85 and SEQ ID NO: 33 or a variant of either thereof as herein described. A preferred recombinant microorganism of the invention may expression the combination of sequences set out in Table 8 (in combination with any UGT2, but in particular that encoded by SEQ ID NO: 87).

A nucleotide sequence encoding a UGT may for instance comprise a sequence as set out in SEQ ID NO: 35, 37, 39, 41, 43, 45, 47, 49, 51, 71, 73, 75, 168, 169, 170, 171, 172, 173, 174, 175, 176, 147, 148, 149, 87, 181, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 189, 190, 191 or 192.

A nucleotide sequence encoding a hydroxymethylglutaryl-CoA reductase may for instance comprise a sequence as set out in SEQ ID NO: 79.

A nucleotide sequence encoding a farnesyl-pyrophosphate synthetase may for instance comprise a sequence as set out in SEQ ID NO: 81.

A nucleotide sequence encoding a geranylgeranyl diphosphate synthase may for instance comprise a sequence as set out in SEQ ID NO:83.

A nucleotide sequence encoding a NADPH-cytochrome p450 reductase may for instance comprise a sequence as set out in SEQ ID NO: 53, 55, 57 or 77.

In the case of the UGT sequences, combinations of at least one from each of: (i) SEQ ID NOs: 35, 37, 168, 169, 71, 147 or 189; (ii) SEQ ID NOs: 87, 99, 101, 103, 105, 107, 109, 111, 181 or 192; (iii) SEQ ID NOs: 39, 41, 43, 45, 47, 170, 171, 172, 173, 174, 73, 148 or 190; and (iv) SEQ ID NOs: 49, 51, 175, 176, 75, 149 or 191 may be preferred. Typically, at least one UGT from group (i) may be used. If at least one UGT from group (iii) is used, generally at least one UGT from group (i) is also used. If at least one UGT from group (iv) is used, generally at least one UGT from group (i) and at least one UGT from group (iii) is used. Typically, at least one UGT form group (ii) is used.

A sequence which has at least about 10%, about 15%, about 20%, preferably at least about 25%, about 30%, about 40%, about 50%, about 55%, about 60%, about 65%, about 70%, about 75%, about 80%, about 85%, about 90%, about 95%, about 96%, about 97%, about 98%, or about 99% sequence identity with a sequence as mentioned may be used in the invention.

To increase the likelihood that the introduced enzymes are expressed in active form in a eukaryotic cell of the invention, the corresponding encoding nucleotide sequence may be adapted to optimise its codon usage to that of the chosen eukaryote host cell. The adaptiveness of the nucleotide sequences encoding the enzymes to the codon usage of the chosen host cell may be expressed as codon adaptation index (CAI). The codon adaptation index is herein defined as a measurement of the relative adaptiveness of the codon usage of a gene towards the codon usage of highly expressed genes. The relative adaptiveness (w) of each codon is the ratio of the usage of each codon, to that of the most abundant codon for the same amino acid. The CAI index is defined as the geometric mean of these relative adaptiveness values. Non-synonymous codons and termination codons (dependent on genetic code) are excluded. CAI values range from 0 to 1, with higher values indicating a higher proportion of the most abundant codons (see Sharp and Li, 1987, Nucleic Acids Research 15: 1281-1295; also see: Jansen et al., 2003, Nucleic Acids Res. 31(8):2242-51). An adapted nucleotide sequence preferably has a CAI of at least 0.2, 0.3, 0.4, 0.5, 0.6 or 0.7.

In a preferred embodiment the eukaryotic cell according to the present invention is genetically modified with (a) nucleotide sequence(s) which is (are) adapted to the codon usage of the eukaryotic cell using codon pair optimisation technology as disclosed in PCT/EP2007/05594. Codon-pair optimisation is a method for producing a polypeptide in a host cell, wherein the nucleotide sequences encoding the polypeptide have been modified with respect to their codon-usage, in particular the codon-pairs that are used, to obtain improved expression of the nucleotide sequence encoding the polypeptide and/or improved production of the polypeptide. Codon pairs are defined as a set of two subsequent triplets (codons) in a coding sequence.

Further improvement of the activity of the enzymes in vivo in a eukaryotic host cell of the invention, can be obtained by well-known methods like error prone PCR or directed evolution. A preferred method of directed evolution is described in WO03010183 and WO03010311.

The microorganism according to the present invention may be any suitable host cell from microbial origin. Preferably, the host cell is a yeast or a filamentous fungus. More preferably, the host cell belongs to one of the genera *Saccharomyces, Aspergillus, Penicillium, Pichia, Kluyveromyces, Yarrowia, Candida, Hansenula, Humicola, Torulaspora, Trichosporon, Brettanomyces, Pachysolen* or *Yamadazyma* or *Zygosaccharomyces*.

A more preferred microorganism belongs to the species *Aspergillus niger, Penicillium chrysogenum, Pichia stipidis, Kluyveromyces marxianus, K. lactis, K. thermotolerans, Yarrowia lipolytica, Candida sonorensis, C. glabrata, Hansenula polymorpha, Torulaspora delbrueckii, Brettanomyces bruxellensis, Zygosaccharomyces bailii, Saccharomyces uvarum, Saccharomyces bayanus* or *Saccharomyces cerevisiae* species. Preferably, the eukaryotic cell is a *Saccharomyces cerevisiae*.

A recombinant yeast cell according to the invention may be modified so that the ERG9 gene is down-regulated and or the ERG5/ERG6 genes are deleted. Corresponding genes may be modified in this way in other microorganisms.

Such a microorganism may be transformed as set out herein, whereby the nucleotide sequence(s) with which the microorganism is transformed confer(s) on the cell the ability to produce a diterpene or glycoside thereof.

A preferred microorganism according to the invention is a yeast such as a *Saccharomyces cerevisiae* or *Yarrowia lipolytica* cell. A recombinant microorganism of the invention, such as a recombinant *Saccharomyces cerevisiae* cell or *Yarrowia lipolytica* cell may comprise one or more nucleotide sequence(s) from each of the following groups:

(i) SEQ ID NO: 1, 3, 5, 7, 17, 19, 59, 61, 141, 142, 152, 153, 154, 159, 160, 182 or 184.

(ii) SEQ ID NO: 9, 11, 13, 15, 17, 19, 63, 65, 143, 144, 155, 156, 157, 158, 159, 160, 183 or 184.

(iii) SEQ ID NO: 21, 23, 25, 67 85, 145, 161, 162, 163, 180 or 186.

(iv) SEQ ID NO: 27, 29, 31, 33, 69, 89, 91, 93, 95, 97, 146, 164, 165, 166, 167 or 185.

Such a microorganism will typically also comprise one or more nucleotide sequence(s) as set out in SEQ ID NO: 53, 55, 57 or 77.

Such a microorganism may also comprise one or more nucleotide sequences as set out in 35, 37, 39, 41, 43, 45, 47, 49, 51, 71, 73, 75, 168, 169, 170, 171, 172, 173, 174, 175, 176, 147, 148, 149, 87, 181, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 189, 190, 191 or 192. In the case of these sequences, combinations of at least one from each of (i) SEQ ID NOs:

35, 37, 168, 169, 71, 147 or 189; (ii) SEQ ID NOs: 87, 99, 101, 103, 105, 107, 109, 111, 181 or 192; (iii) SEQ ID NOs: 39, 41, 43, 45, 47, 170, 171, 172, 173, 174, 73, 148 or 190; and (iv) SEQ ID NOs: 49, 51, 175, 176, 75, 149 or 191 may be preferred. Typically, at least one UGT from group (i) may be used. If at least one UGT from group (iii) is used, generally at least one UGT from group (i) is also used. If at least one UGT from group (iv) is used, generally at least one UGT from group (i) and at least one UGT from group (iii) is used. Typically, at least one UGT form group (ii) is used.

Such a microorganism may also comprise the following nucleotide sequences: SEQ ID NO:79; SEQ ID NO:81; and SEQ ID NO:83.

For each sequence set out above (or any sequence mentioned herein), a variant having at least about 15%, preferably at least about 20, about 25, about 30, about 40, about 50, about 55, about 60, about 65, about 70, about 75, about 80, about 85, about 90, about 95, about 96, about 97, about 98, or about 99%, sequence identity with the stated sequence may be used.

The nucleotide sequences encoding the ent-copalyl pyrophosphate synthase, ent-Kaurene synthase, ent-Kaurene oxidase, kaurenoic acid 13-hydroxylase, UGTs, hydroxymethylglutaryl-CoA reductase, farnesyl-pyrophosphate synthetase, geranylgeranyl diphosphate synthase and NADPH-cytochrome p450 reductase may be ligated into one or more nucleic acid constructs to facilitate the transformation of the microorganism according to the present invention.

A nucleic acid construct may be a plasmid carrying the genes encoding enzymes of the diterpene, eg. steviol/steviol glycoside, pathway as described above, or a nucleic acid construct may comprise two or three plasmids carrying each three or two genes, respectively, encoding the enzymes of the diterpene pathway distributed in any appropriate way.

Any suitable plasmid may be used, for instance a low copy plasmid or a high copy plasmid.

It may be possible that the enzymes selected from the group consisting of ent-copalyl pyrophosphate synthase, ent-Kaurene synthase, ent-Kaurene oxidase, and kaurenoic acid 13-hydroxylase, UGTs, hydroxymethylglutaryl-CoA reductase, farnesyl-pyrophosphate synthetase, geranylgeranyl diphosphate synthase and NADP H-cytochrome p450 reductase are native to the host microorganism and that transformation with one or more of the nucleotide sequences encoding these enzymes may not be required to confer the host cell the ability to produce a diterpene or diterpene glycosidase. Further improvement of diterpene/diterpene glycosidase production by the host microorganism may be obtained by classical strain improvement.

The nucleic acid construct may be maintained episomally and thus comprise a sequence for autonomous replication, such as an autosomal replication sequence sequence. If the host cell is of fungal origin, a suitable episomal nucleic acid construct may e.g. be based on the yeast 2µ or pKD1 plasmids (Gleer et al., 1991, Biotechnology 9: 968-975), or the AMA plasmids (Fierro et al., 1995, Curr Genet. 29:482-489).

Alternatively, each nucleic acid construct may be integrated in one or more copies into the genome of the host cell. Integration into the host cell's genome may occur at random by non-homologous recombination but preferably the nucleic acid construct may be integrated into the host cell's genome by homologous recombination as is well known in the art (see e.g. WO90/14423, EP-A-0481008, EP-A-0635 574 and U.S. Pat. No. 6,265,186).

Optionally, a selectable marker may be present in the nucleic acid construct. As used herein, the term "marker" refers to a gene encoding a trait or a phenotype which permits the selection of, or the screening for, a microorganism containing the marker. The marker gene may be an antibiotic resistance gene whereby the appropriate antibiotic can be used to select for transformed cells from among cells that are not transformed. Alternatively or also, non-antibiotic resistance markers are used, such as auxotrophic markers (URA3, TRP1, LEU2). The host cells transformed with the nucleic acid constructs may be marker gene free. Methods for constructing recombinant marker gene free microbial host cells are disclosed in EP-A-0 635 574 and are based on the use of bidirectional markers. Alternatively, a screenable marker such as Green Fluorescent Protein, lacZ, luciferase, chloramphenicol acetyltransferase, beta-glucuronidase may be incorporated into the nucleic acid constructs of the invention allowing to screen for transformed cells. A preferred marker-free method for the introduction of heterologous polynucleotides is described in WO0540186.

In a preferred embodiment, the nucleotide sequences encoding ent-copalyl pyrophosphate synthase, ent-Kaurene synthase, ent-Kaurene oxidase, and kaurenoic acid 13-hydroxylase, UGTs, hydroxymethylglutaryl-CoA reductase, farnesyl-pyrophosphate synthetase, geranylgeranyl diphosphate synthase and NADP H-cytochrome p450 reductase, are each operably linked to a promoter that causes sufficient expression of the corresponding nucleotide sequences in the eukaryotic cell according to the present invention to confer to the cell the ability to produce a diterpene or diterpene glycoside.

As used herein, the term "operably linked" refers to a linkage of polynucleotide elements (or coding sequences or nucleic acid sequence) in a functional relationship. A nucleic acid sequence is "operably linked" when it is placed into a functional relationship with another nucleic acid sequence. For instance, a promoter or enhancer is operably linked to a coding sequence if it affects the transcription of the coding sequence.

As used herein, the term "promoter" refers to a nucleic acid fragment that functions to control the transcription of one or more genes, located upstream with respect to the direction of transcription of the transcription initiation site of the gene, and is structurally identified by the presence of a binding site for DNA-dependent RNA polymerase, transcription initiation sites and any other DNA sequences, including, but not limited to transcription factor binding sites, repressor and activator protein binding sites, and any other sequences of nucleotides known to one of skilled in the art to act directly or indirectly to regulate the amount of transcription from the promoter. A "constitutive" promoter is a promoter that is active under most environmental and developmental conditions. An "inducible" promoter is a promoter that is active under environmental or developmental regulation.

The promoter that could be used to achieve the expression of the nucleotide sequences coding for an enzyme as defined herein above, may be not native to the nucleotide sequence coding for the enzyme to be expressed, i.e. a promoter that is heterologous to the nucleotide sequence (coding sequence) to which it is operably linked. Preferably, the promoter is homologous, i.e. endogenous to the host cell Suitable promoters in microorganisms of the invention may be GAL7, GAL10, or GAL 1, CYC1, HIS3, ADH1, PGL, PH05, GAPDH, ADC1, TRP1, URA3, LEU2, ENO, TPI, and AOX1. Other suitable promoters include PDC, GPD1, PGK1, TEF1, and TDH. Further suitable promoters are set out in the Examples.

Any terminator, which is functional in the cell, may be used in the present invention. Preferred terminators are obtained from natural genes of the host cell. Suitable terminator sequences are well known in the art. Preferably, such terminators are combined with mutations that prevent nonsense mediated mRNA decay in the host cell of the invention (see for example: Shirley et al., 2002, Genetics 161:1465-1482).

Nucleotide sequences used in the invention may include sequences which target them to desired compartments of the microorganism. For example, in a preferred microorganism of the invention, all nucleotide sequences, except for ent-Kaurene oxidase, kaurenoic acid 13-hydroxylase and NADPH-cytochrome p450 reductase encoding sequences may be targeted to the cytosol. This approach may be used in a yeast cell.

The term "homologous" when used to indicate the relation between a given (recombinant) nucleic acid or polypeptide molecule and a given host organism or host cell, is understood to mean that in nature the nucleic acid or polypeptide molecule is produced by a host cell or organisms of the same species, preferably of the same variety or strain.

The term "heterologous" when used with respect to a nucleic acid (DNA or RNA) or protein refers to a nucleic acid or protein that does not occur naturally as part of the organism, cell, genome or DNA or RNA sequence in which it is present, or that is found in a cell or location or locations in the genome or DNA or RNA sequence that differ from that in which it is found in nature. Heterologous nucleic acids or proteins are not endogenous to the cell into which it is introduced, but have been obtained from another cell or synthetically or recombinantly produced.

Typically, recombinant microorganism of the invention will comprise heterologous nucleotide sequences. Alternatively, a recombinant microorganism of the invention may comprise entirely homologous sequence which has been modified as set out herein so that the microorganism produces increased amounts of a diterpene and/or diterpene glycoside in comparison to a non-modified version of the same microorganism.

One or more enzymes of the diterpene pathway as described herein may be overexpressed to achieve a sufficient diterpene production by the cell.

There are various means available in the art for overexpression of enzymes in the host cells of the invention. In particular, an enzyme may be overexpressed by increasing the copy number of the gene coding for the enzyme in the host cell, e.g. by integrating additional copies of the gene in the host cell's genome.

A preferred host cell according to the present invention may be a recombinant cell which is naturally capable of producing GGPP.

A recombinant microorganism according to the present invention may be able to grow on any suitable carbon source known in the art and convert it to a diterpene or a diterpene glycoside. The recombinant microorganism may be able to convert directly plant biomass, celluloses, hemicelluloses, pectines, rhamnose, galactose, fucose, maltose, maltodextrines, ribose, ribulose, or starch, starch derivatives, sucrose, lactose and glycerol. Hence, a preferred host organism expresses enzymes such as cellulases (endocellulases and exocellulases) and hemicellulases (e.g. endo- and exo-xylanases, arabinases) necessary for the conversion of cellulose into glucose monomers and hemicellulose into xylose and arabinose monomers, pectinases able to convert pectines into glucuronic acid and galacturonic acid or amylases to convert starch into glucose monomers. Preferably, the host cell is able to convert a carbon source selected from the group consisting of glucose, xylose, arabinose, sucrose, lactose and glycerol. The host cell may for instance be a eukaryotic host cell as described in WO03/062430, WO06/009434, EP1499708B1, WO2006096130 or WO04/099381.

In a further aspect, the present invention relates to a process for the production of a diterpene or diterpene glycoside comprising fermenting a transformed eukaryotic cell according to the present invention in a suitable fermentation medium, and optionally recovering the diterpene and/or diterpene glycoside.

The fermentation medium used in the process for the production of a diterpene or diterpene glycoside may be any suitable fermentation medium which allows growth of a particular eukaryotic host cell. The essential elements of the fermentation medium are known to the person skilled in the art and may be adapted to the host cell selected.

Preferably, the fermentation medium comprises a carbon source selected from the group consisting of plant biomass, celluloses, hemicelluloses, pectines, rhamnose, galactose, fucose, fructose, maltose, maltodextrines, ribose, ribulose, or starch, starch derivatives, sucrose, lactose, fatty acids, triglycerides and glycerol. Preferably, the fermentation medium also comprises a nitrogen source such as ureum, or an ammonium salt such as ammonium sulphate, ammonium chloride, ammoniumnitrate or ammonium phosphate.

The fermentation process according to the present invention may be carried out in batch, fed-batch or continuous mode. A separate hydrolysis and fermentation (SHF) process or a simultaneous saccharification and fermentation (SSF) process may also be applied. A combination of these fermentation process modes may also be possible for optimal productivity. A SSF process may be particularly attractive if starch, cellulose, hemicelluose or pectin is used as a carbon source in the fermentation process, where it may be necessary to add hydrolytic enzymes, such as cellulases, hemicellulases or pectinases to hydrolyse the substrate.

The recombinant microorganism used in the process for the preparation of a diterpene or diterpene glycoside may be any suitable microorganism as defined herein above. It may be advantageous to use a recombinant eukaryotic microorganism according to the invention in the process for the production of a diterpene or diterpene glycoside, because most eukaryotic cells do not require sterile conditions for propagation and are insensitive to bacteriophage infections. In addition, eukaryotic host cells may be grown at low pH to prevent bacterial contamination.

The recombinant microorganism according to the present invention may be a facultative anaerobic microorganism. A facultative anaerobic microorganism can be propagated aerobically to a high cell concentration. This anaerobic phase can then be carried out at high cell density which reduces the fermentation volume required substantially, and may minimize the risk of contamination with aerobic microorganisms.

The fermentation process for the production of a diterpene according to the present invention may be an aerobic or an anaerobic fermentation process.

An anaerobic fermentation process may be herein defined as a fermentation process run in the absence of oxygen or in which substantially no oxygen is consumed, preferably less than 5, 2.5 or 1 mmol/L/h, and wherein organic molecules serve as both electron donor and electron acceptors. The fermentation process according to the present invention may also first be run under aerobic conditions and subsequently under anaerobic conditions.

The fermentation process may also be run under oxygen-limited, or micro-aerobical, conditions. Alternatively, the fermentation process may first be run under aerobic conditions and subsequently under oxygen-limited conditions. An oxygen-limited fermentation process is a process in which the oxygen consumption is limited by the oxygen transfer from the gas to the liquid. The degree of oxygen limitation is determined by the amount and composition of the ingoing gasflow as well as the actual mixing/mass transfer properties of the fermentation equipment used.

The production of a diterpene in the process according to the present invention may occur during the growth phase of the host cell, during the stationary (steady state) phase or during both phases. It may be possible to run the fermentation process at different temperatures.

The process for the production of a diterpene or diterpene glycoside may be run at a temperature which is optimal for the eukaryotic cell. The optimum growth temperature may differ for each transformed eukaryotic cell and is known to the person skilled in the art. The optimum temperature might be higher than optimal for wild type organisms to grow the organism efficiently under non-sterile conditions under minimal infection sensitivity and lowest cooling cost. Alternatively, the process may be carried out at a temperature which is not optimal for growth of the recombinant microorganism. Indeed, we have shown that a process for the preparation of a diterpene or diterpene glycoside may be carried out beneficially at a sub-optimal growth temperature of a recombinant microorganism.

The temperature for growth of the recombinant microorganism in a process for production of a diterpene or diterpene glycoside may be above 20° C., 22° C., 25° C., 28° C., or above 30° C., 35° C., or above 37° C., 40° C., 42° C., and preferably below 45° C. During the production phase of a diterpene or diterpene glycoside however, the optimum temperature might be lower than average in order to optimize biomass stability. The temperature during this phase may be below 45° C., for instance below 42° C., 40° C., 37° C., for instance below 35° C., 30° C., or below 28° C., 25° C., 22° C. or below 20° C. preferably above 15° C.

The invention thus provides a process for the preparation of a diterpene or glycosylated diterpene which process comprises fermenting a recombinant microorganism capable of producing a diterpene or glycosylate diterpene in a suitable fermentation medium at a temperature of about 29° C. or less, and optionally recovering the diterpene or glycosylated diterpene. The microorganism may be a microorganism according to the invention.

The temperature of fermentation in such a process may be about 29° C. or less, about 28° C. or less, about 27° C. or less, about 26° C. or less or at a lower temperature.

The process for the production of a diterpene or diterpene glycoside according to the present invention may be carried out at any suitable pH value. If the recombinant microorganism is yeast, the pH in the fermentation medium preferably has a value of below 6, preferably below 5.5, preferably below 5, preferably below 4.5, preferably below 4, preferably below pH 3.5 or below pH 3.0, or below pH 2.5, preferably above pH 2. An advantage of carrying out the fermentation at these low pH values is that growth of contaminant bacteria in the fermentation medium may be prevented.

Such a process may be carried out on an industrial scale. The product of such a process may be one or more of steviolmonoside, steviolbioside, stevioside or rebaudioside A, rebaudioside B, rebaudioside C, rebaudioside D, rebaudioside E, rebaudioside F, rubusoside, dulcoside A. Preferably, rebaudioside A or rebaudioside D is produced.

Recovery of the diterpene or diterpene glycoside from the fermentation medium may be performed by known methods in the art, for instance by distillation, vacuum extraction, solvent extraction, or evaporation.

In the process for the production of a diterpene or diterpene glycoside according to the invention, it may be possible to achieve a concentration of above 5 mg/l fermentation broth, preferably above 10 mg/l, preferably above 20 mg/l, preferably above 30 mg/l fermentation broth, preferably above 40 mg/l, more preferably above 50 mg/l, preferably above 60 mg/l, preferably above 70, preferably above 80 mg/l, preferably above 100 mg/l, preferably above 1 g/l, preferably above 5 g/l, preferably above 10 g/l, but usually below 70 g/l.

The present invention also relates to a fermentation broth comprising a diterpene and/or diterpene glycoside obtainable by the process according to the present invention. The diterpene or glycosylated diterpene may be a steviol glycoside, in particular rebaudioside A or rebaudioside D.

In the event that a diterpene or diterpene glycoside is expressed within the microorganism, such cells may need to be treated so as to release the diterpene/diterpene glycoside.

The invention also relates to a method for converting a first glycosylated diterpene into a second glycosylated diterpene, which method comprises:

contacting said first glycosylated diterpene with a microorganism as herein described, a cell free extract derived from such a microorganism or an enzyme preparation derived from either thereof, thereby to convert the first glycosylated diterpene into the second glycosylated diterpene.

The second glycosylated diterpene may be rebaudioside A or rebuadioside D. In particular, the method may be carried out in a format such that the first glycosylated diterpene is rebaudioside A and the second glycosylated diterpene is rebaudioside D.

The diterpene or diterpene glycoside, for example rebaudioside A or rebuadioside D, produced by the fermentation process according to the present invention may be used in any application known for such compounds. In particular, they may for instance be used as a sweetener, for example in a food or a beverage. For example steviol glycosides may be formulated in soft drinks, as a tabletop sweetener, chewing gum, dairy product such as yoghurt (eg. plain yoghurt), cake, cereal or cereal-based food, nutraceutical, pharmaceutical, edible gel, confectionery product, cosmetic, toothpastes or other oral cavity composition, etc. In addition, a diterpene or diterpene glycoside can be used as a sweetener not only for drinks, foodstuffs, and other products dedicated for human consumption, but also in animal feed and fodder with improved characteristics.

Accordingly, the invention provides, inter alia, a foodstuff, feed or beverage which comprises a diterpene or glycosylated prepared according to a process of the invention.

During the manufacturing of foodstuffs, drinks, pharmaceuticals, cosmetics, table top products, chewing gum the conventional methods such as mixing, kneading, dissolution, pickling, permeation, percolation, sprinkling, atomizing, infusing and other methods can be used.

The diterpene or diterpene glycoside obtained in this invention can be used in dry or liquid forms. It can be added before or after heat treatment of food products. The amount of the sweetener depends on the purpose of usage. It can be added alone or in the combination with other compounds.

Compounds produced according to the method of the invention may be blended with one or more further non-calorific or calorific sweeteners. Such blending may be used to improve flavour or temporal profile or stability. A wide range of both non-calorific and calorific sweeteners may be suitable for blending with steviol glycosides. For example, non-calorific sweeteners such as mogroside, monatin, aspartame, acesulfame salts, cyclamate, sucralose, saccharin salts or erythritol. Calorific sweeteners suitable for blending with steviol glycosides include sugar alcohols and carbohydrates such as sucrose, glucose, fructose and HFCS. Sweet tasting amino acids such as glycine, alanine or serine may also be used.

The diterpene or diterpene glycoside can be used in the combination with a sweetener suppressor, such as a natural sweetener suppressor. It may be combined with an umami taste enhancer, such as an amino acid or a salt thereof.

A diterpene or diterpene glycoside can be combined with a polyol or sugar alcohol, a carbohydrate, a physiologically active substance or functional ingredient (for example a carotenoid, dietary fiber, fatty acid, saponin, antioxidant, nutraceutical, flavonoid, isothiocyanate, phenol, plant sterol or stanol (phytosterols and phytostanols), a polyols, a prebiotic, a probiotic, a phytoestrogen, soy protein, sulfides/thiols, amino acids, a protein, a vitamin, a mineral, and/or a substance classified based on a health benefits, such as cardiovascular, cholesterol-reducing or anti-inflammatory.

A composition with a diterpene or diterpene glycoside may include a flavoring agent, an aroma component, a nucleotide, an organic acid, an organic acid salt, an inorganic acid, a bitter compound, a protein or protein hydrolyzate, a surfactant, a flavonoid, an astringent compound, a vitamin, a dietary fiber, an antioxidant, a fatty acid and/or a salt.

A diterpene or diterpene glycoside of the invention may be applied as a high intensity sweetener to produce zero calorie, reduced calorie or diabetic beverages and food products with improved taste characteristics. Also it can be used in drinks, foodstuffs, pharmaceuticals, and other products in which sugar cannot be used.

In addition, a diterpene or diterpene glycoside of the invention may be used as a sweetener not only for drinks, foodstuffs, and other products dedicated for human consumption, but also in animal feed and fodder with improved characteristics.

The examples of products where a diterpene or diterpene glycoside of the invention composition can be used as a sweetening compound can be as alcoholic beverages such as vodka, wine, beer, liquor, sake, etc; natural juices, refreshing drinks, carbonated soft drinks, diet drinks, zero calorie drinks, reduced calorie drinks and foods, yogurt drinks, instant juices, instant coffee, powdered types of instant beverages, canned products, syrups, fermented soybean paste, soy sauce, vinegar, dressings, mayonnaise, ketchups, curry, soup, instant bouillon, powdered soy sauce, powdered vinegar, types of biscuits, rice biscuit, crackers, bread, chocolates, caramel, candy, chewing gum, jelly, pudding, preserved fruits and vegetables, fresh cream, jam, marmalade, flower paste, powdered milk, ice cream, sorbet, vegetables and fruits packed in bottles, canned and boiled beans, meat and foods boiled in sweetened sauce, agricultural vegetable food products, seafood, ham, sausage, fish ham, fish sausage, fish paste, deep fried fish products, dried seafood products, frozen food products, preserved seaweed, preserved meat, tobacco, medicinal products, and many others. In principal it can have unlimited applications.

The sweetened composition comprises a beverage, non-limiting examples of which include non-carbonated and carbonated beverages such as colas, ginger ales, root beers, ciders, fruit-flavored soft drinks (e.g., citrus-flavored soft drinks such as lemon-lime or orange), powdered soft drinks, and the like; fruit juices originating in fruits or vegetables, fruit juices including squeezed juices or the like, fruit juices containing fruit particles, fruit beverages, fruit juice beverages, beverages containing fruit juices, beverages with fruit flavorings, vegetable juices, juices containing vegetables, and mixed juices containing fruits and vegetables; sport drinks, energy drinks, near water and the like drinks (e.g., water with natural or synthetic flavorants); tea type or favorite type beverages such as coffee, cocoa, black tea, green tea, oolong tea and the like; beverages containing milk components such as milk beverages, coffee containing milk components, cafe au lait, milk tea, fruit milk beverages, drinkable yogurt, lactic acid bacteria beverages or the like; and dairy products.

Generally, the amount of sweetener present in a sweetened composition varies widely depending on the particular type of sweetened composition and its desired sweetness. Those of ordinary skill in the art can readily discern the appropriate amount of sweetener to put in the sweetened composition.

The diterpene or diterpene glycoside of the invention obtained in this invention can be used in dry or liquid forms. It can be added before or after heat treatment of food products. The amount of the sweetener depends on the purpose of usage. It can be added alone or in the combination with other compounds.

During the manufacturing of foodstuffs, drinks, pharmaceuticals, cosmetics, table top products, chewing gum the conventional methods such as mixing, kneading, dissolution, pickling, permeation, percolation, sprinkling, atomizing, infusing and other methods can be used.

Thus, compositions of the present invention can be made by any method known to those skilled in the art that provide homogenous even or homogeneous mixtures of the ingredients. These methods include dry blending, spray drying, agglomeration, wet granulation, compaction, co-crystallization and the like.

In solid form a diterpene or diterpene glycoside of the invention of the present invention can be provided to consumers in any form suitable for delivery into the comestible to be sweetened, including sachets, packets, bulk bags or boxes, cubes, tablets, mists, or dissolvable strips. The composition can be delivered as a unit dose or in bulk form.

For liquid sweetener systems and compositions convenient ranges of fluid, semi-fluid, paste and cream forms, appropriate packing using appropriate packing material in any shape or form shall be invented which is convenient to carry or dispense or store or transport any combination containing any of the above sweetener products or combination of product produced above.

The composition may include various bulking agents, functional ingredients, colorants, flavors.

A reference herein to a patent document or other matter which is given as prior art is not to be taken as an admission that that document or matter was known or that the information it contains was part of the common general knowledge as at the priority date of any of the claims.

The disclosure of each reference set forth herein is incorporated herein by reference in its entirety.

The present invention is further illustrated by the following Examples:

EXAMPLES

General

Standard genetic techniques, such as overexpression of enzymes in the host cells, as well as for additional genetic modification of host cells, are known methods in the art, such as described in Sambrook and Russel (2001) "Molecular Cloning: A Laboratory Manual (3rd edition), Cold Spring Harbor Laboratory, *Cold Spring Harbor Laboratory Press*, or F. Ausubel et al, eds., "Current protocols in molecular biology", Green Publishing and Wiley Interscience, New York (1987). Methods for transformation and genetic modification of fungal host cells are known from e.g. EP-A-0 635 574, WO 98/46772, WO 99/60102 and WO 00/37671.

A description of the sequences is set out in Table 1. Sequences described herein may be defined with reference to the sequence listing or with reference to the database accession numbers also set out in Table 1.

Example 1. Over-Expression of ERG20, BTS1 and tHMG in *S. cerevisiae*

For over-expression of ERG20, BTS1 tHMG1, expression cassettes were designed to be integrated in one locus using technology described in co-pending patent application no. PCT/EP2013/056623. To amplify the 5' and 3' integration flanks for the integration locus, suitable primers and genomic DNA from a CEN.PK yeast strain (van Dijken et al. Enzyme and Microbial Technology 26 (2000) 706-714) was used. The different genes were ordered as cassettes (containing homologous sequence, promoter, gene, terminator, homologous sequence) at DNA2.0. The genes in these cassettes were flanked by constitutive promoters and terminators. See Table 2. Plasmid DNA from DNA2.0 containing the ERG20, tHMG1 and BTS1 cassettes were dissolved to a concentration of 100 ng/µ. In a 50 µl PCR mix 20 ng template was used together with 20 pmol of the primers. The material was dissolved to a concentration of 0.5 µg/µl.

TABLE 2

Composition of the over-expression constructs.

| Promoter | ORF | Terminator |
|---|---|---|
| Eno2 (SEQ ID NO: 201) | Erg20 (SEQ ID NO: 81) | Adh1 (SEQ ID NO: 212) |
| Fba1 (SEQ ID NO: 202) | tHMG1 (SEQ ID NO: 79) | Adh2 (SEQ ID NO: 213) |
| Tef1 (SEQ ID NO: 203) | Bts1 (SEQ ID NO: 83) | Gmp1 (SEQ ID NO: 214) |

For amplification of the selection marker, the pUG7-EcoRV construct (FIG. 1) and suitable primers were used. The KanMX fragment was purified from gel using the Zymoclean Gel DNA Recovery kit (ZymoResearch). Yeast strain Cen.PK113-3C was transformed with the fragments listed in Table 3.

TABLE 3

DNA fragments used for transformation of ERG20, tHMG1 and BTS1

| Fragment |
|---|
| 5'YPRcTau3 |
| ERG20 cassette |
| tHMG1 cassette |
| KanMX cassatte |
| BTS1 cassette |
| 3'YPRcTau3 |

Figure 2:
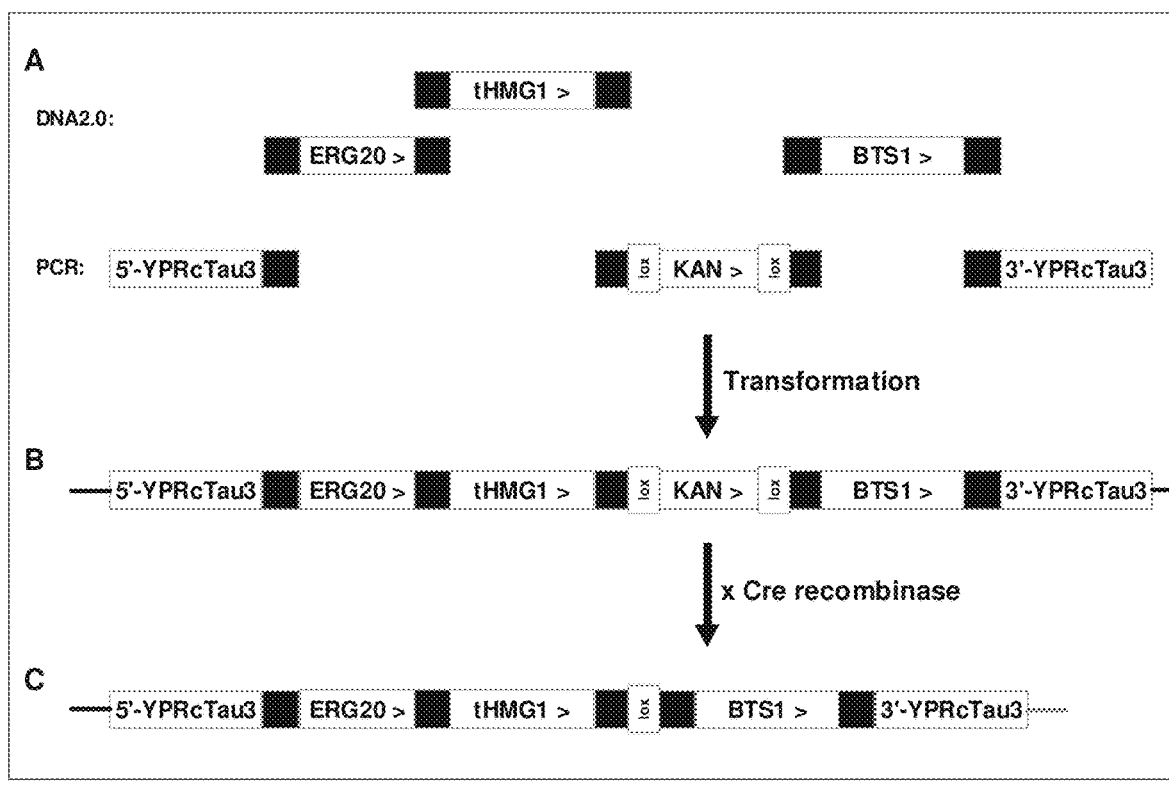
FIG. 2 sets out a schematic representation of the method by which the ERG20, tHMG1 and BTS1 over-expression cassettes are designed (A) and integrated (B) into the yeast genome. (C) shows the final situation after removal of the KANMX marker by the Cre recombinase.

After transformation and recovery for 2.5 hours in YEPhD (yeast extract phytone peptone glucose; BBL Phytone Peptone from BD) at 30° C. the cells were plated on YEPhD agar with 200 µg/mlG418 (Sigma). The plates were incubated at 30° C. for 4 days. Correct integration was established with diagnostic PCR and sequencing. Overexpression was confirmed with LC/MS on the proteins. The schematic of the assembly of ERG20, tHMG1 and BTS1 is illustrated in FIG. 2. This strain is named STV002.

Expression of the CRE-recombinase in this strain led to out-recombination of the KanMX marker. Correct out-recombination, and presence of ERG20, tHMG and BTS1 was established with diagnostic PCR.

Example 2. Knock Down of Erg9

For reducing the expression of Erg9, an Erg9 knock down construct was designed and used that contains a modified 3' end, that continues into the TRP1 promoter driving TRP1 expression.

Figure 3:
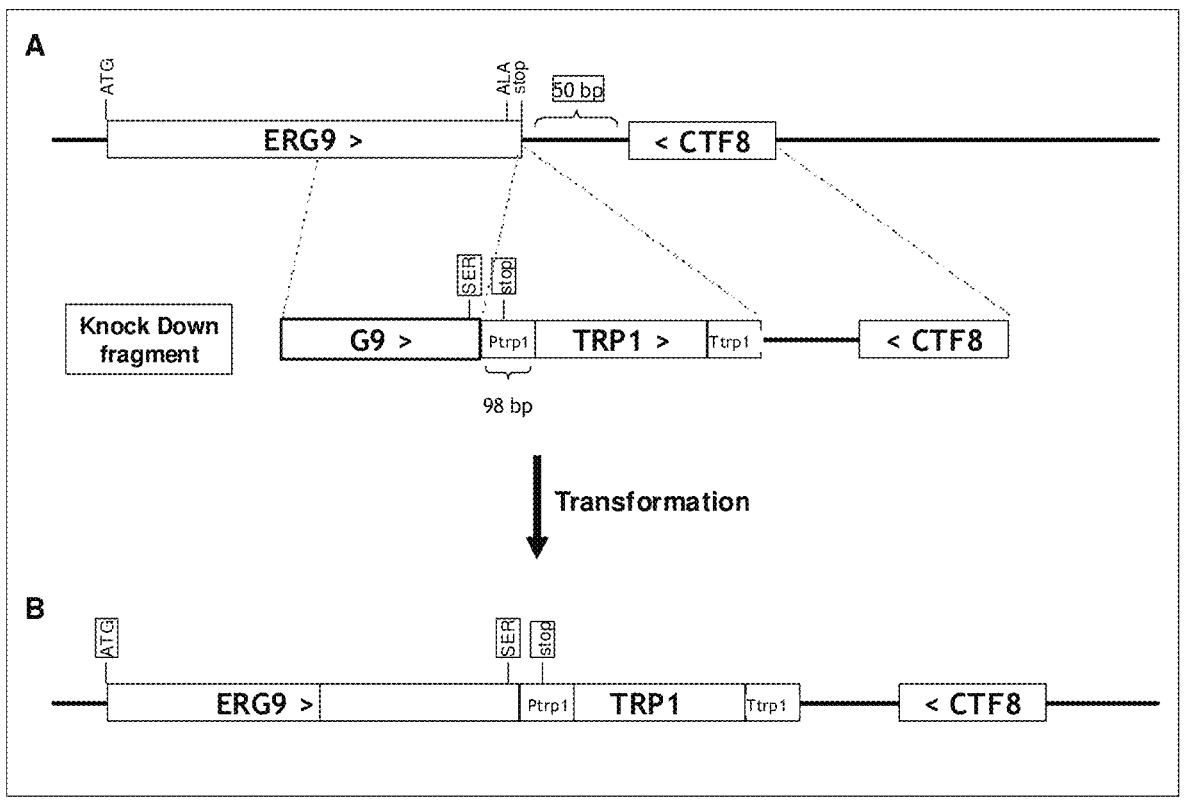
FIG. 3 sets out a schematic representation of the ERG9 knock down construct. This consists of a 500 bp long 3' part of ERG9, 98 bp of the TRP1 promoter, the TRP1 open reading frame and terminator, followed by a 400 bp long downstream sequence of ERG9. Due to introduction of a XbaI site at the end of the ERG9 open reading frame the last amino acid changes into Ser and the stop codon into Arg. A new stop codon is located in the TPR1 promoter, resulting in an extension of 18 amino acids.

The construct containing the Erg9-KD fragment was transformed to *E. coli* TOP10 cells. Transformants were grown in 2PY (2 times Phytone peptone Yeast extract), sAMP medium. Plasmid DNA was isolated with the QIAprep Spin Miniprep kit (Qiagen) and digested with SalI-HF (New England Biolabs). To concentrate, the DNA was precipitated with ethanol. The fragment was transformed to *S. cerevisiae*, and colonies were plated on mineral medium (Verduyn et al, 1992. Yeast 8:501-517) agar plates without tryptophan. Correct integration of the Erg9-KD construct was confirmed with diagnostic PCR and sequencing. The schematic of performed transformation of the Erg9-KD construct is illustrated in FIG. 3. The strain was named STV003.

Example 3. Over-Expression of UGT2 1a

For over-expression of UGT2_1a, technology was used as described in co-pending patent application nos. PCT/EP2013/056623 and PCT/EP2013/055047. The UGT2_1a was ordered as a cassette (containing homologous sequence, promoter, gene, terminator, homologous sequence) at DNA2.0. For details, see Table 4. To obtain the fragments containing the marker and Cre-recombinase, technology was used as described in co-pending patent application no. PCT/EP2013/055047. The NAT marker, conferring resistance to nourseothricin was used for selection.

TABLE 4

Composition of the over-expression construct

| Promoter | ORF | Terminator |
|---|---|---|
| Pgk1 (SEQ ID NO: 204) | UGT2_1a (SEQ ID NO: 87) | Adh2 (SEQ ID NO: 213) |

Suitable primers were used for amplification. To amplify the 5' and 3' integration flanks for the integration locus, suitable primers and genomic DNA from a CEN.PK yeast strain was used.

*S. cerevisiae* yeast strain STV003 was transformed with the fragments listed in Table 5, and the transformation mix was plated on YEPhD agar plates containing 50 µg/ml nourseothricin (Lexy NTC from Jena Bioscience).

TABLE 5

DNA fragments used for transformation of UGT2_1a
Fragment

5'Chr09.01
UGT2_1a cassette
NAT-CR
RE
3'Chr09.01

Figure 4:
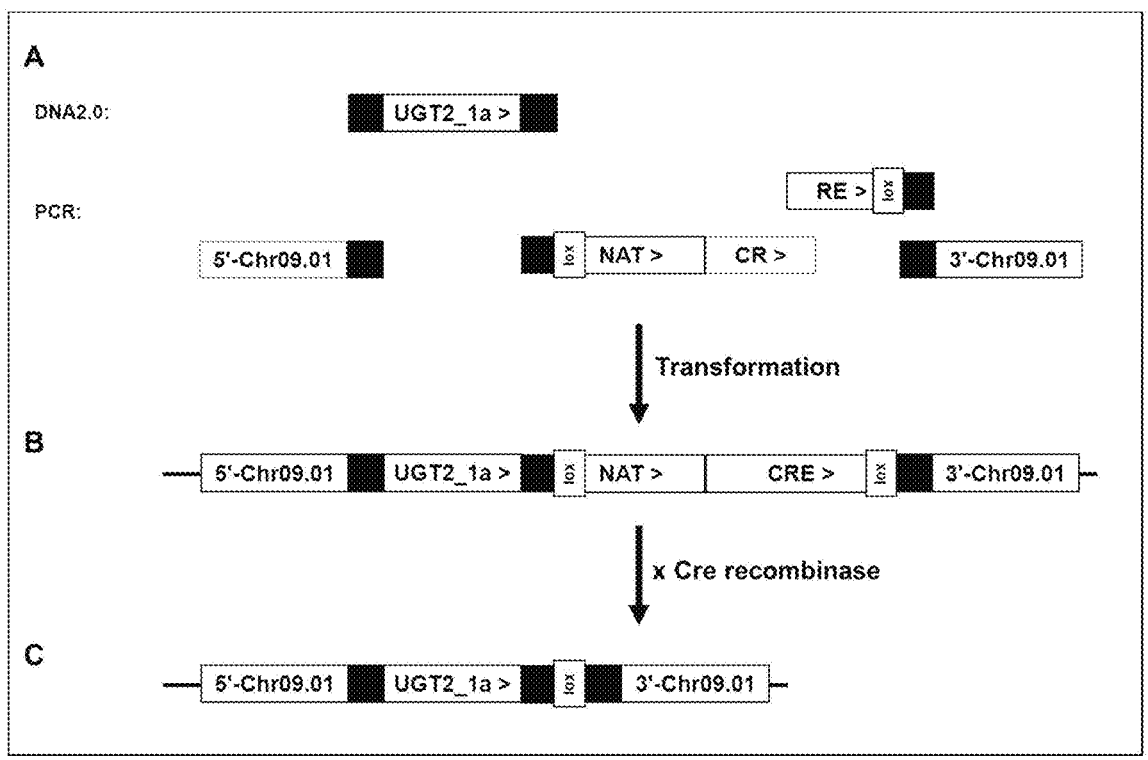
FIG. 4 sets out a schematic representation of how UGT2 is integrated into the genome. A. different fragments used in transformation; B. situation after integration; C. situation after expression of Cre recombinase.

Expression of the CRE recombinase is activated by the presence of galactose. To induce the expression of the CRE recombinase, transformants were restreaked on YEPh Galactose medium. This resulted in out-recombination of the marker(s) located between lox sites. Correct integration of the UGT2a and out-recombination of the NAT marker was confirmed with diagnostic PCR. The resulting strain was named STV004. The schematic of the performed transformation of the UGT2_1a construct is illustrated in FIG. 4.

Example 4. Over-Expression of Production Pathway to RebA: CPS, KS, KO, KAH, CPR, UGT1, UGT3 and UGT4

All pathway genes leading to the production of RebA were designed to be integrated in one locus using technology described in co-pending patent application no. PCT/EP2013/056623. To amplify the 5' and 3' integration flanks for the integration locus, suitable primers and genomic DNA from a CEN.PK yeast strain was used. The different genes were ordered as cassettes (containing homologous sequence, promoter, gene, terminator, homologous sequence) at DNA2.0 (see Table 5 for overview). The DNA from DNA2.0 was dissolved to 100 ng/µl. This stock solution was further diluted to 5 ng/µl, of which 1 µl was used in a 50 µl-PCR mixture. The reaction contained 25 pmol of each primer. After amplification, DNA was purified with the NucleoSpin 96 PCR Clean-up kit (Macherey-Nagel) or alternatively concentrated using ethanol precipitation.

TABLE 6

Sequences used for production pathway to RebA

| Promoter | ORF | SEQ ID | Terminator |
| --- | --- | --- | --- |
| Kl prom 12.pro (SEQ ID NO: 205) | trCPS_SR | 61 | Sc ADH2.ter(SEQ ID NO:) |
| Sc PGK1.pro (SEQ ID NO: 204) | trKS_SR | 65 | Sc TAL1.ter (SEQ ID NO: 215) |
| Sc ENO2.pro (SEQ ID NO: 201) | KO_2 | 23 | Sc TPI1.ter (SEQ ID NO: 216) |
| Ag lox_TEF1.pro (SEQ ID NO: 206) | KANMX | 211 | Ag TEF1_lox.ter (SEQ ID NO: 217) |
| Sc TEF1.pro (SEQ ID NO: 203) | KAH_4 | 33 | Sc GPM1.ter (SEQ ID NO: 214) |
| Kl prom 6.pro (SEQ ID NO: 207) | CPR_SR | 59 | Sc PDC1.ter (SEQ ID NO: 218) |
| Kl prom 3.pro (SEQ ID NO: 221) | UGT1_SR | 71 | Sc TDH1.ter (SEQ ID NO: 219) |

TABLE 6-continued

Sequences used for production pathway to RebA

| Promoter | ORF | SEQ ID | Terminator |
| --- | --- | --- | --- |
| Kl prom 2.pro (SEQ ID NO: 222) | UGT3_SR | 73 | Sc ADH1.ter (SEQ ID NO: 212) |
| Sc FBA1.pro (SEQ ID NO: 202) | UGT4_SR | 75 | Sc ENO1.ter (SEQ ID NO: 220) |

All fragments for the pathway to RebA, the marker and the flanks (see overview in Table 7) were transformed to *S. cerevisiae* yeast strain STV004. After overnight recovery in YEPhD at 20° C. the transformation mixes were plated on YEPhD agar containing 200 µg/ml G418. These were incubated 3 days at 25° C. and one night at RT.

TABLE 7

DNA fragments used for transformation of CPS, KS, KO, KanMX, KAH, CPR, UGT1, UGT3 and UGT4.
Fragment 5'INT1
CPS cassette
KS cassette
KO cassette
KanMX cassette
KAH cassette
CPR cassette
UGT1 cassette
UGT3 cassette
UGT4 cassette
3'INT1

Figure 5:
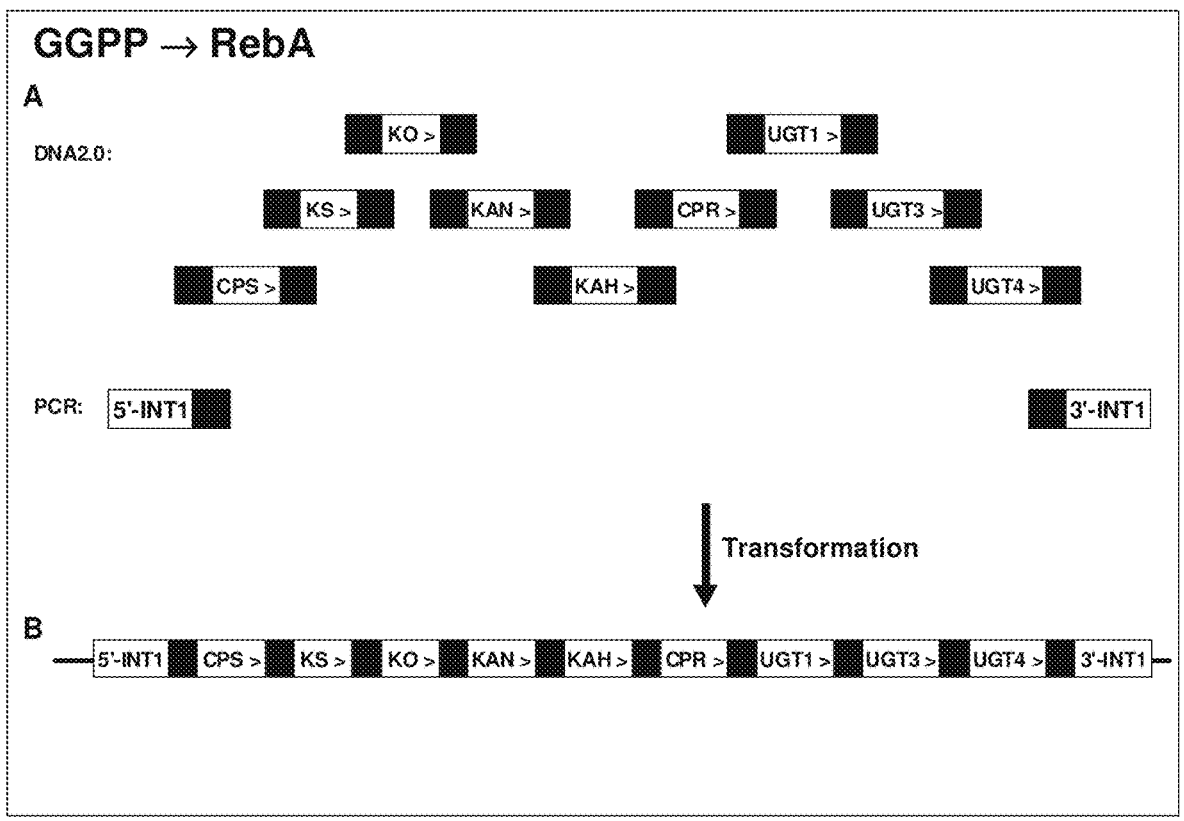
FIG. 5 sets out a schematic representation of how the pathway from GGPP to RebA is integrated into the genome. A. different fragments used in transformation; B. situation after integration.

Correct integration was confirmed with diagnostic PCR and sequence analysis (3500 Genetic Analyzer, Applied Biosystems). The sequence reactions were done with the BigDye Terminator v3.1 Cycle Sequencing kit (Life Technologies). Each reaction (10 µl) contained 50 ng template and 3.2 pmol primer. The products were purified by ethanol/EDTA precipitation, dissolved in 10 µl HiDi formamide and applied onto the apparatus. The strain was named STV016. The schematic of how the pathway from GGPP to RebA is integrated into the genome is illustrated in FIG. 5.

Example 5: Construction of Strain STV027

To remove the KanMX marker from the chromosome of strain STV016, this strain was transformed with plasmid pSH65, expressing Cre-recombinase (Güldender, 2002). Subsequently plasmid pSH65 was cured from the strain by growing on non-selective medium (YEP 2% glucose). The resulting, KanMX-free and pSH65-free strains, as determined by plating on plates containing 200 µg G418/ml or 20 µg phleomycin/ml, where no growth should occur, was named STV027. Absence of the KanMX marker was furthermore confirmed with diagnostic PCR.

Example 6: Construction of Deletion Strains

Gene knock-out strains were obtained using technology that has been described in co-pending patent application no. PCT/EP2013/055047. For the purpose of deleting a target gene, a knock out cassette which consists of 4 PCR fragments is transformed to *S. cerevisiae* and assembled in vivo through homologous recombination. The cassette consists of a 5'- and 3'-flank of approximately 500 bp homologous to the targeted gene, a Cre1 KanMX fragment and a Cre2 fragment containing the selectable KanMX marker after assembly. Together, KanMX and Cre are flanked by lox sites enabling out-recombination after induction of Cre recombinase. The PCR fragments are designed to have homologous regions to their neighboring fragment enabling in vivo assembly after transformation. This homologous region is added by means of primer extension. The 5'-flank fragment has a 50 bp overlap with the Cre1 KanMX fragment, the Cre1 KanMX fragment has 100 bp overlap with the Cre2 fragment and the Cre2 fragment has 50 bp overlap with the 3'-flank fragment.

The 5'- and 3'-flank fragments were PCR amplified using a S. cerevisiae CEN-PK genomic DNA isolate as template. To obtain the fragments containing the marker and Cre-recombinase, technology was used as described in co-pending patent application no. PCT/EP2013/055047. The KanMX marker, conferring resistance to G418 was used for selection.

Figure 6:
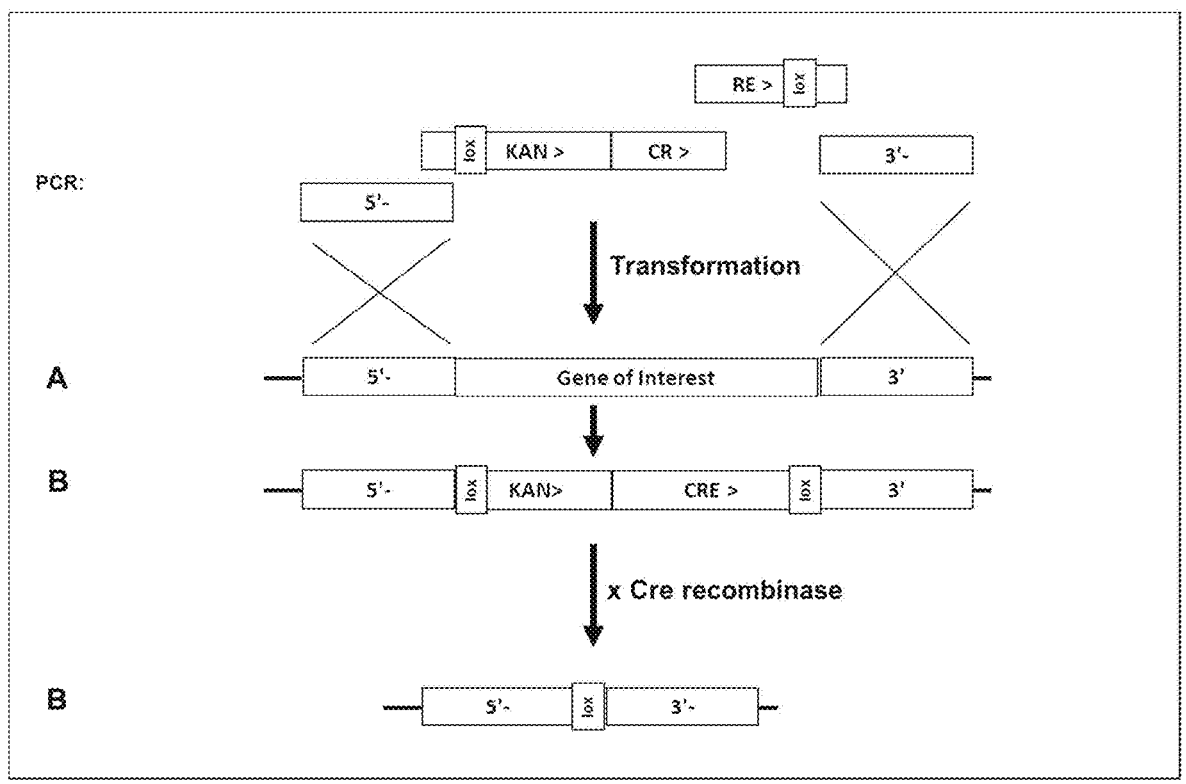
FIG. 6 sets out a schematic representation of how specific gene deletions are constructed. A. genome in the parent strain; B. situation after integration; C. situation after out-recombination FIG. 7 sets out a schematic diagram of the potential pathways leading to biosynthesis of steviol glycosides.

S. cerevisiae yeast strain STV027 was transformed with the fragments listed in Table 8, and the transformation mix was plated on YEPhD agar plates containing 200 μg/ml G418. The plates were incubated for 72 hours at 30° C. The schematic of how the target genes were deleted is illustrated in FIG. 6.

TABLE 8

DNA fragments used for deletion of specific genes. The 5'-GOI (gene of interest) and 3'-GOI (gene of interest) fragments are unique for each deletion target.

| Fragment |
| --- |
| 5'-GOI |
| KAN-CR |
| RE |
| 3'-GOI |

Colonies of each gene KO target were selected and purified by streaking them on selective YEPh-D agar containing 200 μg/ml G418. To induce the expression of the CRE recombinase, purified transformants were inoculated in YEPh Galactose medium. This resulted in out-recombination of the KanMX and Cre located between lox sites. The cultures were purified by streaking on non-selective YEPh-D agar medium. Correct deletion of the target gene and out-recombination of the KanMX marker and Cre-recombinase was confirmed with diagnostic PCR. The resulting strains were named STV041-STV052 The schematic of the performed transformation of the deletion construct is illustrated in FIG. 6. Table 8 summarizes the S. cerevisiae strains that were constructed.

TABLE 8

S. cerevisiae strains

| Strain | Background | Genotype |
| --- | --- | --- |
| Cen.PK113-3C | — | MATa URA3 HIS3 LEU2 trp1-289 MAL2-8C SUC2 |
| STV002 | Cen.PK113-3C | MATa URA3 HIS3 LEU2 trp1-289 MAL2-8C SUC2 YPRcTau3::ERG20, tHMG1, KanMX, BTS1 |
| STV003 | STV002 | MATa URA3 HIS3 LEU2 trp1-289 MAL2-8C SUC2 YPRcTau3::ERG20, tHMG1, KanMX, BTS1 ERG9::ERG9-KD TRP1 |
| STV004 | STV003 | MATa URA3 HIS3 LEU2 trp1-289 MAL2-8C SUC2 YPRcTau3::ERG20, tHMG1, BTS1 ERG9::ERG9-KD TRP1 Chr09.01::UGT2 |
| STV016 | STV004 | MATa URA3 HIS3 LEU2 trp1-289 MAL2-8C SUC2 YPRcTau3::ERG20, tHMG1, BTS1 ERG9::ERG9-KD TRP1 Chr09.01::UGT2 INT1::CPS, KS, KO, KanMX, KAH, CPR, UGT1, UGT3, UGT4 |
| STV027 | STV016 | MATa URA3 HIS3 LEU2 trp1-289 MAL2-8C SUC2 YPRcTau3::ERG20, tHMG1, BTS1 ERG9::ERG9-KD TRP1 Chr09.01::UGT2 INT1::CPS, KS, KO, KAH, CPR, UGT1, UGT3, UGT4 |
| STV041 | STV027 | MATa URA3 HIS3 LEU2 trp1-289 MAL2-8C SUC2 YPRcTau3::ERG20, tHMG1, BTS1 ERG9::ERG9-KD TRP1 Chr09.01::UGT2 INT1::CPS, KS, KO, KAH, CPR, UGT1, UGT3, UGT4, lpp1Δ0 |
| STV042 | STV027 | MATa URA3 HIS3 LEU2 trp1-289 MAL2-8C SUC2 YPRcTau3::ERG20, tHMG1, BTS1 ERG9::ERG9-KD TRP1 Chr09.01::UGT2 INT1::CPS, KS, KO, KAH, CPR, UGT1, UGT3, UGT4, dpp1Δ0 |
| STV043 | STV027 | MATa URA3 HIS3 LEU2 trp1-289 MAL2-8C SUC2 YPRcTau3::ERG20, tHMG1, BTS1 ERG9::ERG9-KD TRP1 Chr09.01::UGT2 INT1::CPS, KS, KO, KAH, CPR, UGT1, UGT3, UGT4, rox1Δ0 |
| STV044 | STV027 | MATa URA3 HIS3 LEU2 trp1-289 MAL2-8C SUC2 YPRcTau3::ERG20, tHMG1, BTS1 ERG9::ERG9-KD TRP1 Chr09.01::UGT2 INT1::CPS, KS, KO, KAH, CPR, UGT1, UGT3, UGT4, yjl064wΔ0 |
| STV045 | STV027 | MATa URA3 HIS3 LEU2 trp1-289 MAL2-8C SUC2 YPRcTau3::ERG20, tHMG1, BTS1 ERG9::ERG9-KD TRP1 Chr09.01::UGT2 INT1::CPS, KS, KO, KAH, CPR, UGT1, UGT3, UGT4, ypl062wΔ0 |
| STV046 | STV027 | MATa URA3 HIS3 LEU2 trp1-289 MAL2-8C SUC2 YPRcTau3::ERG20, tHMG1, BTS1 ERG9::ERG9-KD TRP1 Chr09.01::UGT2 INT1::CPS, KS, KO, KAH, CPR, UGT1, UGT3, UGT4, exg1Δ0 |
| STV047 | STV027 | MATa URA3 HIS3 LEU2 trp1-289 MAL2-8C SUC2 YPRcTau3::ERG20, tHMG1, BTS1 ERG9::ERG9-KD TRP1 Chr09.01::UGT2 INT1::CPS, KS, KO, KAH, CPR, UGT1, UGT3, UGT4, exg2Δ0 |
| STV048 | STV027 | MATa URA3 HIS3 LEU2 trp1-289 MAL2-8C SUC2 YPRcTau3::ERG20, tHMG1, BTS1 ERG9::ERG9-KD TRP1 Chr09.01::UGT2 INT1::CPS, KS, KO, KAH, CPR, UGT1, UGT3, UGT4, gsy1Δ0 |
| STV049 | STV027 | MATa URA3 HIS3 LEU2 trp1-289 MAL2-8C SUC2 YPRcTau3::ERG20, tHMG1, BTS1 ERG9::ERG9-KD TRP1 Chr09.01::UGT2 INT1::CPS, KS, KO, KAH, CPR, UGT1, UGT3, UGT4, gsy2Δ0 |

TABLE 8-continued

S. cerevisiae strains

| Strain | Background | Genotype |
|---|---|---|
| STV050 | STV027 | MATa URA3 HIS3 LEU2 trp1-289 MAL2-8C SUC2 YPRcTau3::ERG20, tHMG1, BTS1 ERG9::ERG9-KD TRP1 Chr09.01::UGT2 INT1::CPS, KS, KO, KAH, CPR, UGT1, UGT3, UGT4, yno1Δ0 |
| STV052 | STV027 | MATa URA3 HIS3 LEU2 trp1-289 MAL2-8C SUC2 YPRcTau3::ERG20, tHMG1, BTS1 ERG9::ERG9-KD TRP1 Chr09.01::UGT2 INT1::CPS, KS, KO, KAH, CPR, UGT1, UGT3, UGT4, jen1Δ0 |

Example 7: Fermentation Experiments with Deletion Strains

A pre-culture was inoculated with colony material from YEPh-D agar. The pre-culture was grown in 200 μl mineral medium with glucose as carbon source. The pre-culture was incubated 72 hours in an Infors incubator at 27° C., 750 rpm and 80% humidity.

40 μl of pre-culture was used to inoculate 2.5 ml mineral medium with glucose as carbon source. The main cultures were incubated 120 hours in an Infors incubator at 27° C., 550 rpm, 80% humidity. The cultures were well homogenized by pipetting up and down and 1 ml of culture was transferred to a 96-well plate. The 96-well plate was incubated for 15 minutes at 95° C. in a waterbath and cooled down to room temperature. To each well 0.5 ml of acetonitril was added and homogenized by pipetting up and down. The cell debris was pelleted by centrifugation at 3000×g for 10 minutes. The supernatant was diluted 200 times in 33% acetonitril. Samples were analyzed for RebA using LC/MS. RebA (RV0141-94, DAE Pyung Co. Ltd) was used as standard.

We found that the strains that had the particular gene deletions as described, produced higher titers of RebA compared to the parent strain. For an overview of the results, see Table 9.

TABLE 9

Rebaudioside A production.

| Strain | RebA (mg/L) |
|---|---|
| STV027 | 63 |
| STV041 | 104 |
| STV042 | 94 |
| STV043 | 98 |
| STV044 | 115 |
| STV045 | 103 |
| STV046 | 99 |
| STV047 | 100 |
| STV048 | 103 |
| STV049 | 104 |
| STV050 | 97 |
| STV052 | 100 |

Example 8: Over-Expression of UGT2, tHMGopt and GGSopt in Yarrowia lipolytica

All transformations were carried out via a lithium acetate/PEG fungal transformation protocol method and transformants were selected on minimal medium, YPD+100 ug/ml nourseothricin or YPD+100 ug/ml hygromycin, as appropriate.

Strain ML10371 was transformed with 5 defined DNA fragments.

Figure 8:
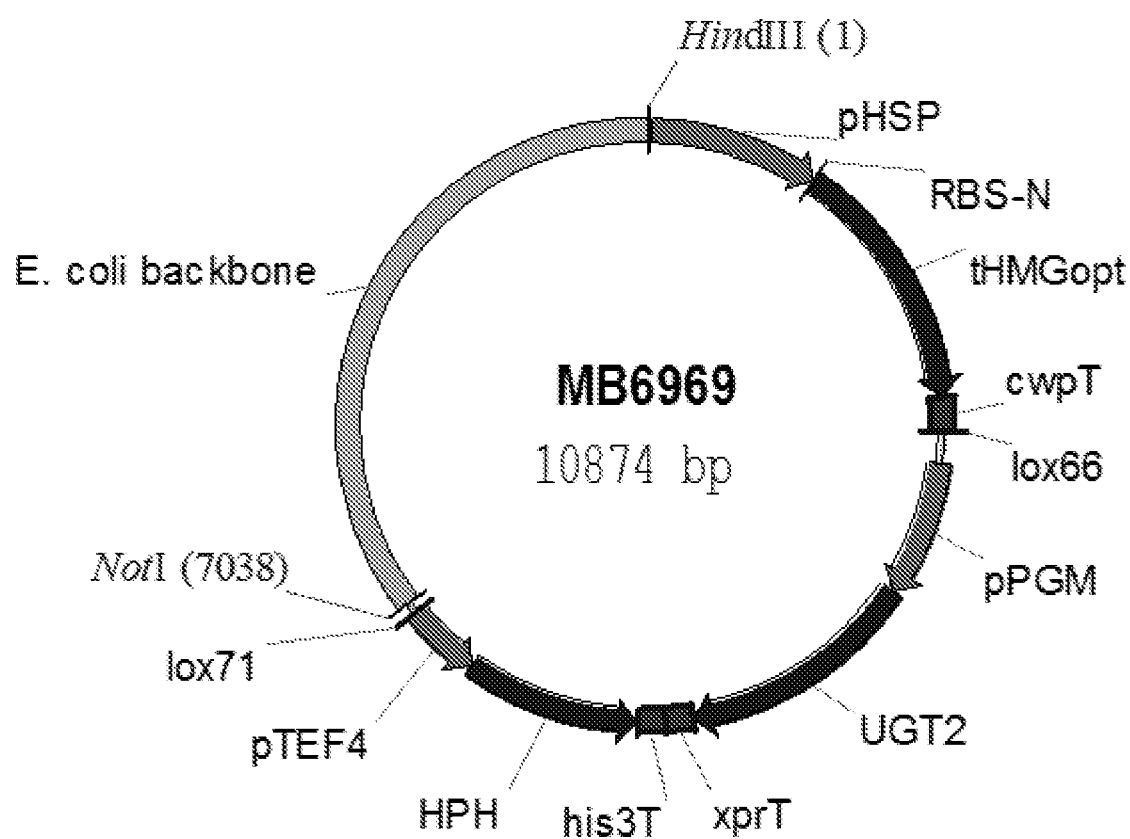
FIG. 8 sets out a schematic diagram of plasmid pMB6969.

1) a 7.0 kb DNA fragment isolated by gel purification following HindIII/NotI digestion of plasmid MB6969 (FIG. 8). This construct encodes a synthetic construct for the overexpression of UGT2 (SEQ ID NO: 192) linked to the native Y. lipolytica pPGM promoter and xprT terminator and the HPH hygromycin resistance gene, together flanked by lox sites, and a synthetic construct for the overexpression of the codon optimized Y. lipolytica hydroxymethylglutaryl-coenzyme A reductase open reading frame lacking the 5' membrane anchor sequence (tHMGopt—SEQ ID NO: 79) linked to the native Y. lipolytica pHSP promoter and cwpT terminator.

Figure 9:
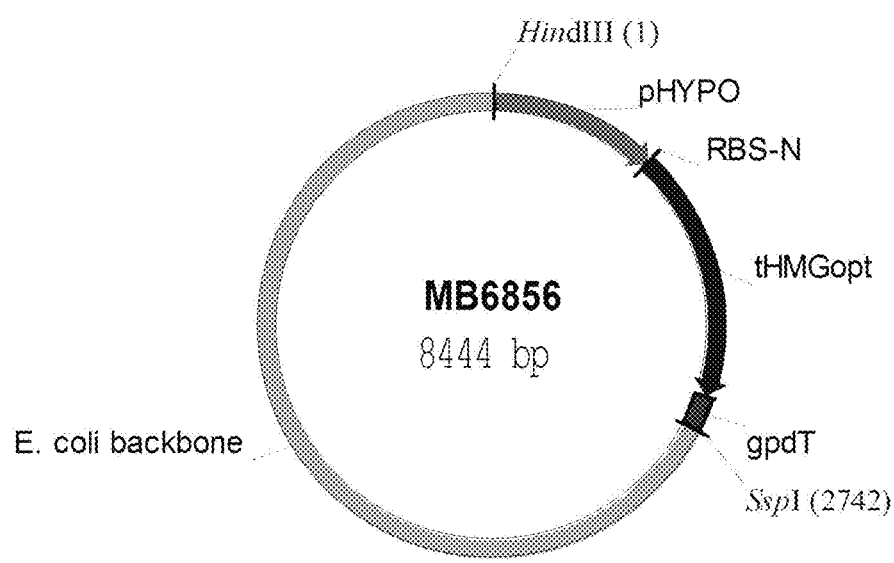
FIG. 9 sets out a schematic diagram of plasmid pMB6856.

2) a 2.7 kb DNA fragment isolated by gel purification following HindIII/SspI digestion of MB6856 (FIG. 9). This construct encodes tHMGopt linked to the native Y. lipolytica pHYPO promoter and gpdT terminator.

Figure 10:
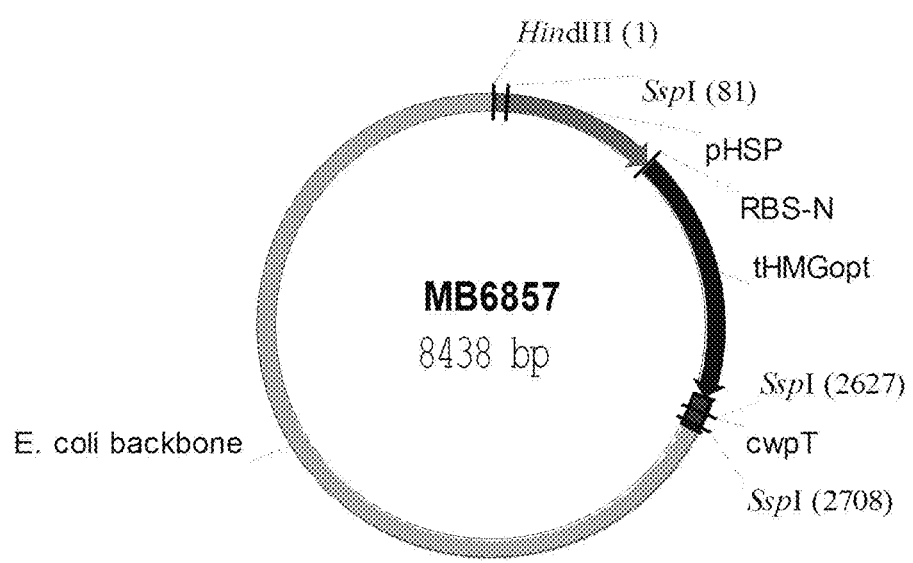
FIG. 10 sets out a schematic diagram of plasmid pMB6857.

3) a 2.5 kb DNA fragment isolated by gel purification following SspI digestion of MB6857 (FIG. 10). This construct encodes tHMGopt linked to the native Y. lipolytica pHSP promoter and cwpT terminator.

Figure 11:
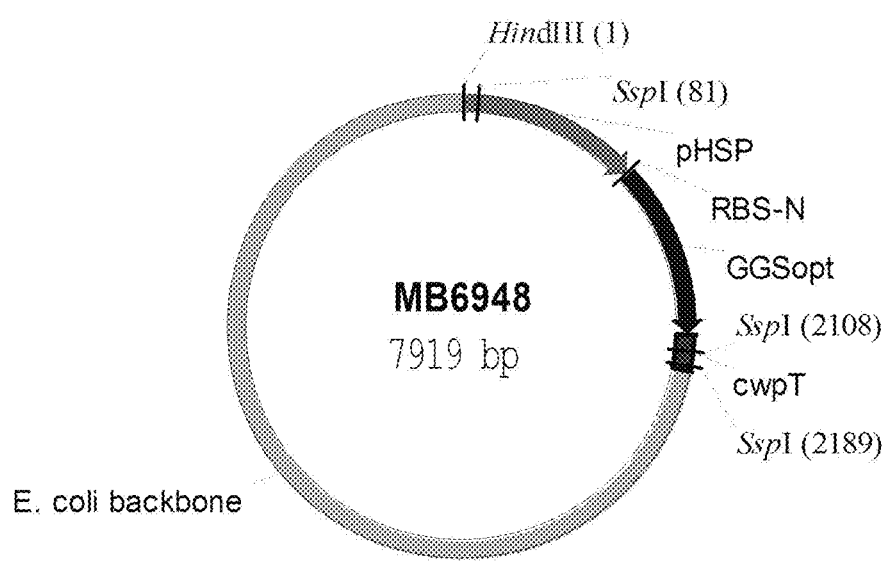
FIG. 11 sets out a schematic diagram of plasmid pMB6948.

4) a 2.0 kb DNA fragment isolated by gel purification following SspI digestion of MB6948 (FIG. 11). This construct encodes a synthetic construct for the overexpression of the codon optimized Y. lipolytica geranyl-geranyl-pyrophosphate synthetase (GGSopt—SEQ ID NO: 83) linked to the native Y. lipolytica pHSP promoter and cwpT terminator.

Figure 12:
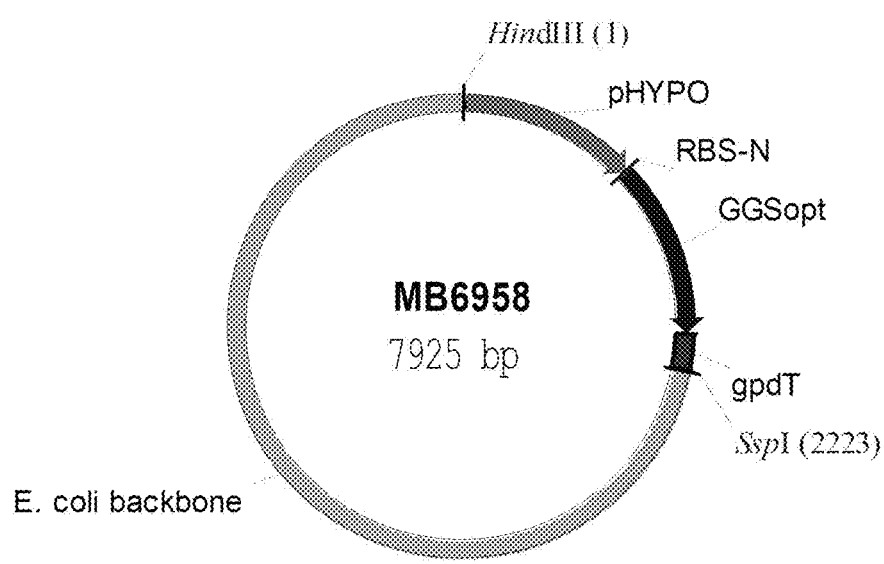
FIG. 12 sets out a schematic diagram of plasmid pMB6958.

5) a 2.2 kb DNA fragment isolated by gel purification following HindIII/SspI digestion of MB6958 (FIG. 12). This construct encodes GGSopt linked to the native Y. lipolytica pHYPO promoter and gpdT terminator.

One of the transformants that contained UGT2, and at least one copy of tHMGopt and GGSopt was denoted ML13462.

Example 9: Over-Expression of UGT1, UGT3 and UGT4

Figure 13:
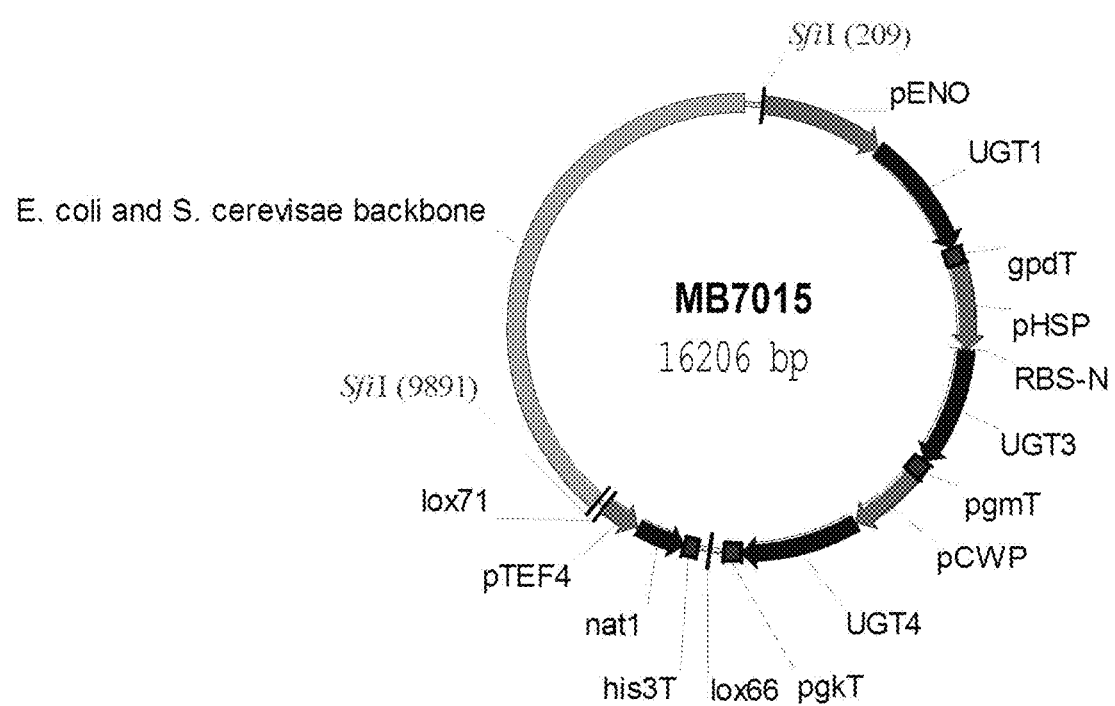
FIG. 13 sets out a schematic diagram of plasmid pMB7015.

Strain ML13462 was transformed with a 9.7 kb fragment isolated by gel purification following SfiI digestion of plasmid MB7015 (FIG. 13). This construct encodes a synthetic construct for the overexpression of UGT1 (SEQ ID NO: 189) linked to the native Y. lipolytica pENO promoter and gpdT terminator, UGT3 (SEQ ID NO: 190) linked to the native Y. lipolytica pHSP promoter and pgmT terminator, UGT4 (SEQ ID NO: 191) linked to the native Y. lipolytica pCWP promoter and pgkT terminator, and the lox-flanked nourseothricin resistance marker (NAT). A nourseothricin resistant isolate was denoted ML13500.

Example 10: Over-Expression of an Additional Copy of tHMGopt and GGSopt

Figure 14:
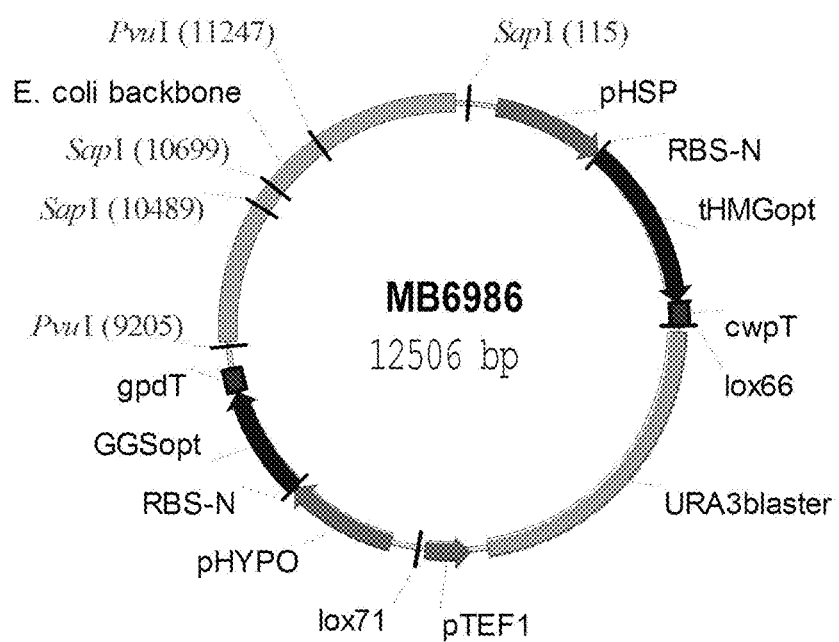
FIG. 14 sets out a schematic diagram of plasmid pMB6986.

Strain ML13500 was transformed with a 9.1 kb fragment isolated by gel purification following PvuI/SapI digestion of plasmid MB6986 (FIG. 14). This construct encodes tHMGopt linked to the native *Y. lipolytica* pHSP promoter and cwpT terminator, the lox-flanked URA3blaster prototrophic marker, and GGSopt linked to the native *Y. lipolytica* pHYPO promoter and gpdT terminator. Transformants were selected on minimal medium lacking uracil. One selected uracil prototroph was denoted ML13723.

Example 11: Over-Expression of tCPS SR, tKS SR, KAH 4, KO Gib and CPR 3

Figure 15:
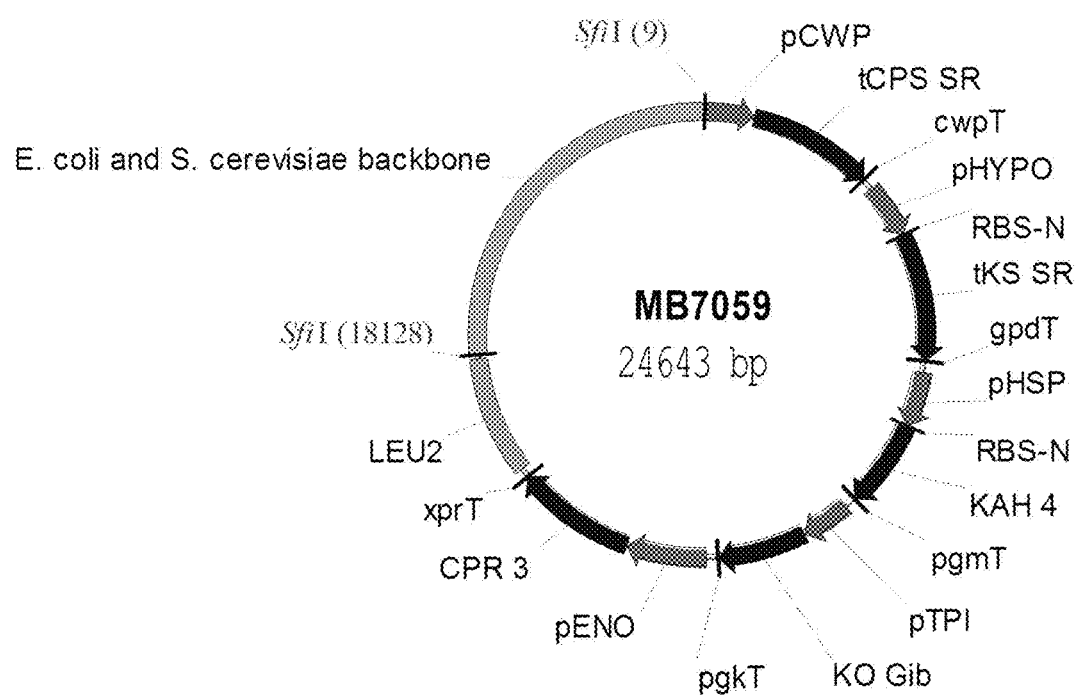
FIG. 15 sets out a schematic diagram of plasmid pMB7059.

Strain ML13723 was transformed with an 18.1 kb fragment isolated by gel purification following SfiI digestion of plasmid MB7059 (FIG. 15). MB7059 encodes the tCPS_SR (SEQ ID NO:182) linked to the native *Y. lipolytica* pCWP promoter and cwpT terminator, the tKS_SR (SEQ ID NO: 183) linked to the native *Y. lipolytica* pHYPO promoter and gpdT terminator, the KAH_4 (SEQ ID NO: 185) linked to the native *Y. lipolytica* pHSP promoter and pgmT terminator, the KO_Gib (SEQ ID NO: 186) linked to the native *Y. lipolytica* pTPI promoter and pgkT terminator, the CPR_3 (SEQ ID NO: 188) linked to the native *Y. lipolytica* pENO promoter and xprT terminator and the native *Y. lipolytica* LEU2 locus. One selected rebaudioside A-producing transformant was denoted ML14032.

Example 12: Disruption of GSY1 (YALI0F18502) in Strain ML14032

Strain ML14032 was struck to YPD and grown overnight and then struck to 5-FOA plates to allow for loss of the URA3 marker introduced in Step 3. One selected 5-FOA—resistant transformant was denoted ML14093.

Figure 16:
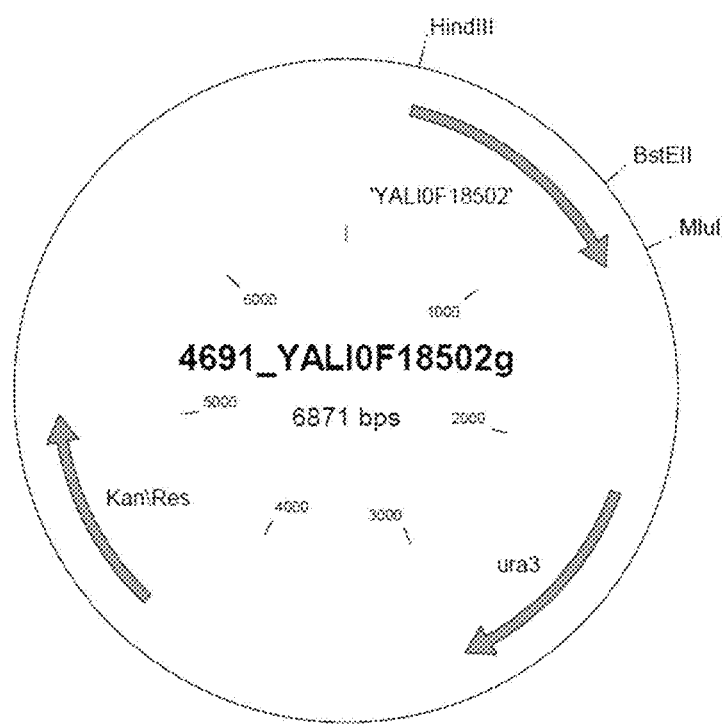
FIG. 16 sets out a schematic diagram of plasmid pMB4691.
Figure 17:
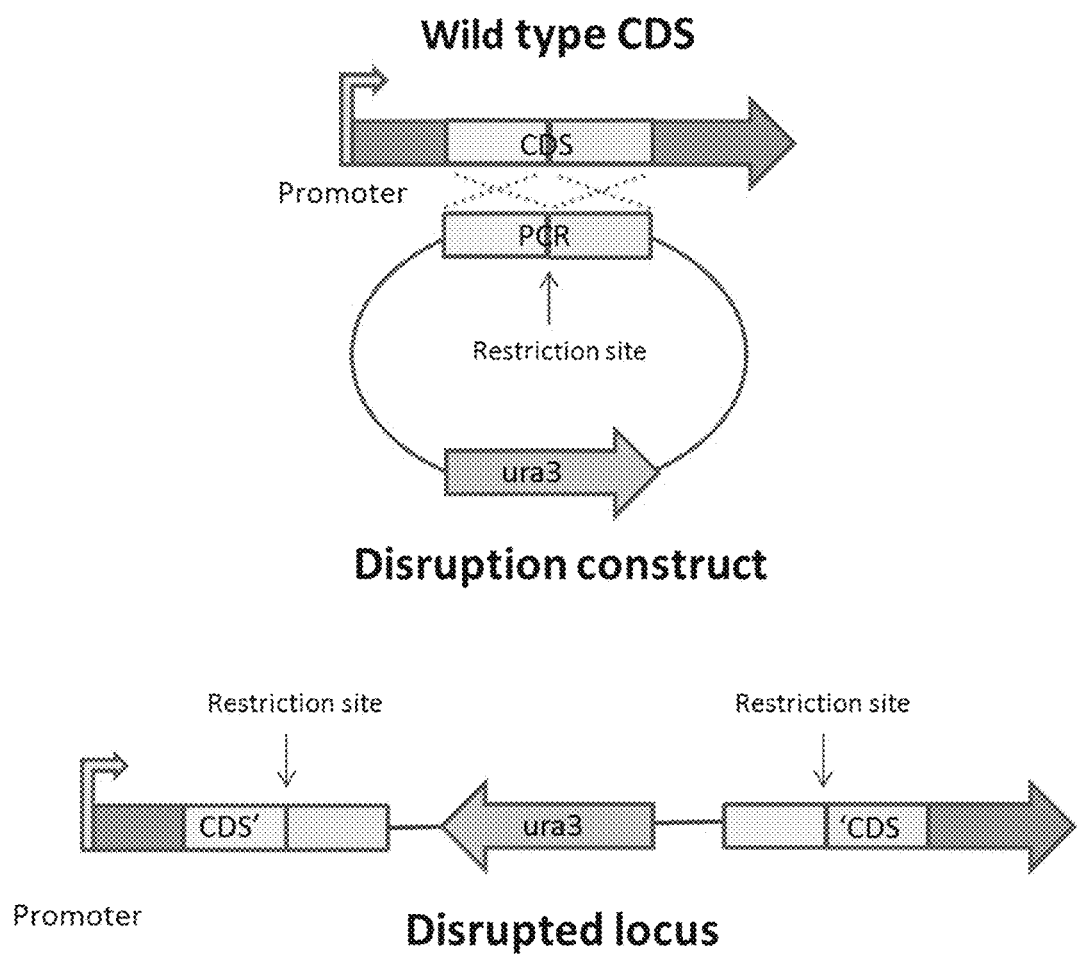
FIG. 17 sets out a schematic diagram of the disruption of the GSY1 gene.

An internal fragment of 1008 bp of the GSY1 gene (1001 to 3073 of SEQ ID NO: 246) was PCR amplified from the *Y. lipolytica* genome using forward primer ATTATTAAGCT-Tcgacattgaggtggaggaga (SEQ ID NO: 247) and reverse primer TAATAAACGCGTtgctgctggatttcgttgac (SEQ ID NO: 248). This internal GSY1 fragment was cloned in an appropriate vector. The resulting vector MB4691_YALI0F18502g (FIG. 16) was linearized with BstEII, for which a unique restriction site was present in the cloned PCR fragment. After transformation and selection on mineral media, transformants were tested for correct integration with diagnostic PCR. The disruption of the GSY1 gene is illustrated in FIG. 17.

Example 13: Fermentation Experiments with *Y. lipolytica* gsy1 Disruption Strain A pre-culture was inoculated with colony material from YEPD agar. The pre-culture was grown in 800 µl YEP with glucose as carbon source. The pre-culture was incubated 72 hours in an Infors incubator at 30° C., 800 rpm and 80% humidity.

40 µl of pre-culture was used to inoculate 2.5 ml YEP with glucose as carbon source. The main cultures were incubated 120 hours in an Infors incubator at 30° C., 800 rpm, 80% humidity. The cultures were spun down and supernatant was analyzed for RebA with LC/MS. RebA (RV0141-94, DAE Pyung Co. Ltd) was used as standard.

The gsy1 disruption strain was compared to the prototrophic precursor strain, ML14032. We found that strains with the GSY1 disruption as described, produced higher titers of RebA, roughly 50% more compared to the parent strain. For an overview of the results, see Table 10.

TABLE 10

| Rebaudioside A production | |
|---|---|
| Strain | RebA (mg/L) |
| ML14032 | 83 |
| ML14093 gsy1 disruption | 122 |

TABLE 1

Description of the sequence listing

| Nucleic acid (CpO for *S. cerevisiae*) | Nucleic acid (CpO for *Y. lipolytica*) | Amino acid | Id* | UniProt^ | Organism |
|---|---|---|---|---|---|
| SEQ ID NO: 1 | SEQ ID NO: 151 | SEQ ID NO: 2 | CPS_1 | Q9FXV9 | *Lactuca sativa* (Garden Lettuce) |
| SEQ ID NO: 3 | SEQ ID NO: 152 | SEQ ID NO: 4 | tCPS_1 | Q9FXV9 | *Lactuca sativa* (Garden Lettuce) |
| SEQ ID NO: 5 | SEQ ID NO: 153 | SEQ ID NO: 6 | CPS_2 | D2X8G0 | *Picea glauca* |
| SEQ ID NO: 7 | SEQ ID NO: 154 | SEQ ID NO: 8 | CPS_3 | Q45221 | *Bradyrhizobium japonicum* |
| SEQ ID NO: 9 | SEQ ID NO: 155 | SEQ ID NO: 10 | KS_1 | Q9FXV8 | *Lactuca sativa* (Garden Lettuce) |
| SEQ ID NO: 11 | SEQ ID NO: 156 | SEQ ID NO: 12 | tKS_1 | Q9FXV8 | *Lactuca sativa* (Garden Lettuce) |
| SEQ ID NO: 13 | SEQ ID NO: 157 | SEQ ID NO: 14 | KS_2 | D2X8G1 | *Picea glauca* |
| SEQ ID NO: 15 | SEQ ID NO: 158 | SEQ ID NO: 16 | KS_3 | Q45222 | *Bradyrhizobium japonicum* |

TABLE 1 -continued

Description of the sequence listing

| Nucleic acid (CpO for *S. cerevisiae*) | Nucleic acid (CpO for *Y. lipolytica*) | Amino acid | Id* | UniProt^ | Organism |
| --- | --- | --- | --- | --- | --- |
| SEQ ID NO: 17 | SEQ ID NO: 159 | SEQ ID NO: 18 | CPSKS_1 | O13284 | *Phaeosphaeria* sp |
| SEQ ID NO: 19 | SEQ ID NO: 160 | SEQ ID NO: 20 | CPSKS_2 | Q9UVY5 | *Gibberella fujikuroi* |
| SEQ ID NO: 21 | SEQ ID NO: 161 | SEQ ID NO: 22 | KO_1 | B5MEX5 | *Lactuca sativa* (Garden Lettuce) |
| SEQ ID NO: 23 | SEQ ID NO: 162 | SEQ ID NO: 24 | KO_2 | B5MEX6 | *Lactuca sativa* (Garden Lettuce) |
| SEQ ID NO: 25 | SEQ ID NO: 163 | SEQ ID NO: 26 | KO_3 | B5DBY4 | *Sphaceloma manihoticola* |
| SEQ ID NO: 27 | SEQ ID NO: 164 | SEQ ID NO: 28 | KAH_1 | Q2HYU7 | *Artemisia annua* (Sweet wormwood). |
| SEQ ID NO: 29 | SEQ ID NO: 165 | SEQ ID NO: 30 | KAH_2 | B9SBP0 | *Ricinus communis* (Castor bean). |
| SEQ ID NO: 31 | SEQ ID NO: 166 | SEQ ID NO: 32 | KAH_3 | Q0NZP1 | *Stevia rebaudiana* |
| SEQ ID NO: 33 | SEQ ID NO: 167 | SEQ ID NO: 34 | KAH_4 | JP2009065886 | *Arabidopsis thaliana* (Mouse-ear cress) |
| SEQ ID NO: 35 | SEQ ID NO: 168 | SEQ ID NO: 36 | UGT1_1 | A9X3L6 | *Ixeris dentata* var. *albiflora*. |
| SEQ ID NO: 37 | SEQ ID NO: 169 | SEQ ID NO: 38 | UGT1_2 | B9SIN2 | *Ricinus communis* (Castor bean). |
| SEQ ID NO: 39 | SEQ ID NO: 170 | SEQ ID NO: 40 | UGT3_1 | A9X3L7 | *Ixeris dentata* var. *Albiflora* |
| SEQ ID NO: 41 | SEQ ID NO: 171 | SEQ ID NO: 42 | UGT3_2 | B9IEM5 | *Populus trichocarpa* (Western balsam poplar) |
| SEQ ID NO: 43 | SEQ ID NO: 172 | SEQ ID NO: 44 | UGT3_3 | Q9M6E7 | *Nicotiana tabacum* |
| SEQ ID NO: 45 | SEQ ID NO: 173 | SEQ ID NO: 46 | UGT3_4 | A3E7Y9 | *Vaccaria hispanica* |
| SEQ ID NO: 47 | SEQ ID NO: 174 | SEQ ID NO: 48 | UGT3_5 | P10249 | *Streptococcus mutans* |
| SEQ ID NO: 49 | SEQ ID NO: 175 | SEQ ID NO: 50 | UGT4_1 | A4F1T4 | *Lobelia erinus* (Edging lobelia) |
| SEQ ID NO: 51 | SEQ ID NO: 176 | SEQ ID NO: 52 | UGT4_2 | Q9M052 | *Arabidopsis thaliana* (Mouse-ear cress) |
| SEQ ID NO: 53 | SEQ ID NO: 177 | SEQ ID NO: 54 | CPR_1 | Q7Z8R1 | *Gibberella fujikuroi* |
| SEQ ID NO: 55 | SEQ ID NO: 178 | SEQ ID NO: 56 | CPR_2 | Q9SB48 | *Arabidopsis thaliana* (Mouse-ear cress) |
| SEQ ID NO: 57 | SEQ ID NO: 179 | SEQ ID NO: 58 | CPR_3 | Q9SUM3 | *Arabidopsis thaliana* (Mouse-ear cress) |
| SEQ ID NO: 59 | SEQ ID NO: 141 | SEQ ID NO: 60 | CPS_SR | O22667 | *Stevia rebaudiana* |
| SEQ ID NO: 61 | SEQ ID NO: 142 | SEQ ID NO: 62 | tCPS_SR | O22667 | *Stevia rebaudiana* |
| SEQ ID NO: 63 | SEQ ID NO: 143 | SEQ ID NO: 64 | KS_SR | Q9XEI0 | *Stevia rebaudiana* |

TABLE 1 -continued

Description of the sequence listing

| Nucleic acid (CpO for S. cerevisiae) | Nucleic acid (CpO for Y. lipolytica) | Amino acid | Id* | UniProt^ | Organism |
|---|---|---|---|---|---|
| SEQ ID NO: 65 | SEQ ID NO: 144 | SEQ ID NO: 66 | tKS_SR | Q9XB10 | Stevia rebaudiana |
| SEQ ID NO: 67 | SEQ ID NO: 145 | SEQ ID NO: 68 | KO_SR | Q4VCL5 | Stevia rebaudiana |
| SEQ ID NO: 69 | SEQ ID NO: 146 | SEQ ID NO: 70 | KAH_SR | U.S. Pat. No. 7,927,851 | Stevia rebaudiana |
| SEQ ID NO: 71 | SEQ ID NO: 147 | SEQ ID NO: 72 | UGT1_SR | Q6VAB0 | Stevia rebaudiana |
| SEQ ID NO: 73 | SEQ ID NO: 148 | SEQ ID NO: 74 | UGT3_SR | Q6VAA6 | Stevia rebaudiana |
| SEQ ID NO: 75 | SEQ ID NO: 149 | SEQ ID NO: 76 | UGT4_SR | Q6VAB4 | Stevia rebaudiana |
| SEQ ID NO: 77 | SEQ ID NO: 150 | SEQ ID NO: 78 | CPR_SR | Q216J8 | Stevia rebaudiana |
| SEQ ID NO: 79 | | SEQ ID NO: 80 | tHMG1 | G2WJY0 | Saccharomyces cerevisiae |
| SEQ ID NO: 81 | | SEQ ID NO: 82 | ERG20 | E7LW73 | Saccharomyces cerevisiae |
| SEQ ID NO: 83 | | SEQ ID NO: 84 | BTS1 | E7Q9V5 | Saccharomyces cerevisiae |
| SEQ ID NO: 85 | SEQ ID NO: 180 | SEQ ID NO: 86 | KO_Gibfu | O94142 | Gibberella fujikuroi |
| SEQ ID NO: 87 | SEQ ID NO: 181 | SEQ ID NO: 88 | UGT2_1a | B3VI56/99% | Stevia rebaudiana |
| SEQ iD NO: 89 | | SEQ ID NO: 90 | KAH_ASR1 | Xxx | S. rebaudiana |
| SEQ ID NO: 91 | | SEQ ID NO: 92 | KAH_ASR2 | Q0NZP1_STERE | S. rebaudiana |
| SEQ ID NO: 93 | | SEQ ID NO: 94 | KAH_AAT | Q6NKZ8_ARATH | A. thaliana |
| SEQ ID NO: 95 | | SEQ ID NO: 96 | KAH_AVV | F6H1Q0_VITVI/98% | Vitis vinifera |
| SEQ ID NO: 97 | | SEQ ID NO: 98 | KAH_AMT | Q2MJ20_MEDTR | Medicago truncatula |
| SEQ ID NO: 99 | | SEQ ID NO: 100 | UGT2_1b | B3VI56/99% | S. rebaudiana |
| SEQ ID NO: 101 | | SEQ ID NO: 102 | UGT2_2 | Q53UH5_IPOPU | I. purpurea |
| SEQ ID NO: 103 | | SEQ ID NO: 104 | UGT2_3 | DGAT_BELPE/99% | Bellis perennis |
| SEQ ID NO: 105 | | SEQ ID NO: 106 | UGT2_4 | B3VI56 | S. rebaudiana |
| SEQ iD NO: 107 | | SEQ ID NO: 108 | UGT2_5 | Q6VAA8 | S. rebaudiana |
| SEQ ID NO: 109 | | SEQ ID NO: 110 | UGT2_6 | Q8LKG3 | S. rebaudiana |
| SEQ ID NO: 111 | | SEQ ID NO: 112 | UGT2_7 | B9HSH7_POPTR | Populus trichocarpa |

TABLE 1-continued

Description of the sequence listing

| Nucleic acid (CpO for S. cerevisiae) | Nucleic acid (CpO for Y. lipolytica) | Amino acid | Id* | UniProt^ | Organism |
|---|---|---|---|---|---|
| SEQ ID NO: 113 | | SEQ ID NO: 114 | UGT_RD1 | Q6VAA3 | S. rebaudiana |
| SEQ ID NO: 115 | | SEQ ID NO: 116 | UGT_RD2 | Q8H6A4 | S. rebaudiana |
| SEQ ID NO: 117 | | SEQ ID NO: 118 | UGT_RD3 | Q6VAA4 | S. rebaudiana |
| SEQ ID NO: 119 | | SEQ ID NO: 120 | UGT_RD4 | Q6VAA5 | S. rebaudiana |
| SEQ ID NO: 121 | | SEQ ID NO: 122 | UGT_RD5 | Q6VAA7 | S. rebaudiana |
| SEQ ID NO: 123 | | SEQ ID NO: 124 | UGT_RD6 | Q6VAA8 | S. rebaudiana |
| SEQ ID NO: 125 | | SEQ ID NO: 126 | UGT_RD7 | Q6VAA9 | S. rebaudiana |
| SEQ ID NO: 127 | | SEQ ID NO: 128 | UGT_RD8 | Q6VAB1 | S. rebaudiana |
| SEQ ID NO: 129 | | SEQ ID NO: 130 | UGT_RD9 | Q6VAB2 | S. rebaudiana |
| SEQ ID NO: 131 | | SEQ ID NO: 132 | UGT_RD10 | Q6VAB3 | S. rebaudiana |
| SEQ ID NO: 133 | | SEQ ID NO: 134 | UGT_RD11 | B9VVB1 | S. rebaudiana |
| SEQ ID NO: 135 | | SEQ ID NO: 136 | UGT_RD12 | C7EA09 | S. rebaudiana |
| SEQ ID NO: 137 | | SEQ ID NO: 138 | UGT_RD13 | Q8LKG3 | S. rebaudiana |
| SEQ ID NO: 139 | | SEQ ID NO: 140 | UGT_RD14 | B3VI56 | S. rebaudiana |
| | SEQ ID NO: 182 | | tCPS | | |
| | SEQ ID NO: 183 | | tKS | | |
| | SEQ ID NO: 184 | | CPSKS | | |
| | SEQ ID NO: 185 | | KAH4 | | |
| | SEQ ID NO: 186 | | KO_Gibfu | | |
| | SEQ ID NO: 187 | | CPR1 | | |
| | SEQ ID NO: 188 | | CPR3 | | |
| | SEQ ID NO: 189 | | UGT1 | | |
| | SEQ ID NO: 190 | | UGT3 | | |
| | SEQ ID NO: 191 | | UGT4 | | |

TABLE 1 -continued

Description of the sequence listing

| Nucleic acid (CpO for *S. cerevisiae*) | Nucleic acid (CpO for *Y. lipolytica*) | Amino acid | Id* | UniProt^ | Organism |
|---|---|---|---|---|---|
| | SEQ ID NO: 192 | | UGT2_1a | | |
| | SEQ ID NO: 193 | | pTPI | | |
| | SEQ ID NO: 194 | | gpdT-pGPD | | |
| | SEQ ID NO: 195 | | pgmT-pTEF | | |
| | SEQ ID NO: 196 | | pgkT-pPGM | | |
| | SEQ ID NO: 197 | | LEU2 and flanking sequences | | |
| | SEQ ID NO: 198 | | vector sequences | | |
| | SEQ ID NO: 199 | | pENO | | |
| | SEQ ID NO: 200 | | HPH | | |
| SEQ ID NO: 201 | | | Sc Eno2.pro | | |
| SEQ ID NO: 202 | | | Sc Fba1.pro | | |
| SEQ ID NO: 203 | | | Sc Tef1.pro | | |
| SEQ ID NO: 204 | | | Sc Pgk1.pro | | |
| SEQ ID NO: 205 | | | Kl prom 12.pro | | |
| SEQ ID NO: 206 | | | Ag lox_TEF1.pro | | |
| SEQ ID NO: 207 | | | Kl prom 6.pro | | |
| SEQ ID NO: 208 | | | Sc Pma1.pro | | |
| SEQ ID NO: 209 | | | Sc Vps68.pro | | |
| SEQ ID NO: 210 | | | Sc Oye2.pro | | |
| SEQ ID NO: 211 | | | KANMX ORF | | |
| SEQ ID NO: 212 | | | Adh1.ter | | |
| SEQ ID NO: 213 | | | Adh2.ter | | |
| SEQ ID NO: 214 | | | Gmp1.ter | | |
| SEQ ID NO: 215 | | | Sc Tal1.ter | | |

TABLE 1-continued

Description of the sequence listing

| Nucleic acid (CpO for S. cerevisiae) | Nucleic acid (CpO for Y. lipolytica) | Amino acid | Id* | UniProt^ | Organism |
|---|---|---|---|---|---|
| SEQ ID NO: 216 | | | Sc Tpi1.ter | | |
| SEQ ID NO: 217 | | | Ag Tef1_lox.ter | | |
| SEQ ID NO: 218 | | | Sc Pdc1.ter | | |
| SEQ ID NO: 219 | | | Sc Tdh1.ter | | |
| SEQ ID NO: 220 | | | Sc Eno1.ter | | |
| SEQ ID NO: 221 | | | Kl prom3.pro | | |
| SEQ ID NO: 222 | | | Kl prom2.pro | | |
| SEQ ID NO: 223 | | | Sc PRE3. Pro | | |
| SEQ ID NO: 224 | | | YDR294C (DPP1) | | S. cerevisiae |
| | | SEQ ID NO: 225 | YDR294C (DPP1) | | S. cerevisiae |
| SEQ ID NO: 226 | | | YDR503C (LPP1) | | S. cerevisiae |
| | | SEQ ID NO: 227 | YDR503C (LPP1) | | S. cerevisiae |
| SEQ ID NO: 228 | | | YLR300W (EXG1) | | S. cerevisiae |
| | | SEQ ID NO: 229 | YLR300W (EXG1) | | S. cerevisiae |
| SEQ ID NO: 230 | | | YDR261C (EXG2) | | S. cerevisiae |
| | | SEQ ID NO: 231 | YDR261C (EXG2) | | S. cerevisiae |
| SEQ ID NO: 232 | | | YFR015C (GSY1) | | S. cerevisiae |
| | | SEQ ID NO: 233 | YFR015C (GSY1) | | S. cerevisiae |
| SEQ ID NO: 234 | | | YLR258W (GSY2) | | S. cerevisiae |
| | | SEQ ID NO: 235 | YLR258W (GSY2) | | S. cerevisiae |
| SEQ ID NO: 236 | | | YPR065W (ROX1) | | S. cerevisiae |
| | | SEQ ID NO: 237 | YPR065W (ROX1) | | S. cerevisiae |
| SEQ ID NO: 238 | | | YGL160W (YNO1) | | S. cerevisiae |
| | | SEQ ID NO: 239 | YGL160W (YNO1) | | S. cerevisiae |
| SEQ ID NO: 240 | | | YKL217W (JEN1) | | S. cerevisiae |
| | | SEQ ID NO: 241 | YKL217W (JEN1) | | S. cerevisiae |
| SEQ ID NO: 242 | | | YJL064W | | S. cerevisiae |
| | | SEQ ID NO: 243 | YJL064W | | S. cerevisiae |

TABLE 1 -continued

Description of the sequence listing

| Nucleic acid (CpO for *S. cerevisiae*) | Nucleic acid (CpO for *Y. lipolytica*) | Amino acid | Id* | UniProt^ | Organism |
|---|---|---|---|---|---|
| SEQ ID NO: 244 | | | YPL062W | | *S. cerevisiae* |
| | | SEQ ID NO: 245 | YPL062W | | *S. cerevisiae* |
| | SEQ ID NO: 246 | | GSY1 sequence | | *Y. lipolytica* |
| | SEQ ID NO: 247 | | Primer | | *Y. lipolytica* |
| | SEQ ID NO: 248 | | Primer | | *Y. lipolytica* |
| | SEQ ID NO: 249 | | YALI0F18502g (GSY1) | | *Y. lipolytica* |
| | | SEQ ID NO: 250 | YALI0F18502p (GSY1) | | *Y. lipolytica* | greyed out ids are truncated and thus a fragment of mentioned UniProt id

SEQUENCE LISTING (250 sequences)

SEQ ID NO: 1 - DNA, 2397 bp, Lactuca sativa
  CDS (1)..(2397)
atgaaaaccatgatttcttctccaatcccagctttccacccaagattttctccagctgctggttccagaagattatctccaatcttgccatcttccggttctgttgtcttgactggttccaagactcaatgtaaggccgtttctaaatctccaactcaagaatactttgatgttttgcaaaagaacggtttgccattcatcaactggcaaaacgatgtcgttgaagatgaattggacaaggaaaagaagatcttgtacccaaacgacgaaatcaagggtttcgttgaaagaatcaaagttatgttaggttccatggacgaaggtgaaatcactgtctctgcttatgacaccgcttgggttgctttggtccaagatatcgatggtaacggtagaccagaatttccttcttctctagaatggatcgtcaagaaccaattatccgatggttcctggggtgaccatttgatcttctctgctcacgacagaatcattaacactttggcttgtgtcattgctttgacttcctggaacgttcatccaggtaagtgtcaaaagggtttaaagttcttgaacgacaacatctccaagttggaagaagaaaacccagaacacatgccaatcggttttgaagttgctttcccatctttgattgatattgccagaaagttggatatccaagttccagaagattccccagctttgaaggaaatttacgccagaagaaacttgaaattgaccaagattccaaagtctttgatgcacaaggttccaactactttgttgcattctttggaaggtatgccagacttggaatgggaaaagttgttgaagctacaatgtaaggatggttctttcttgttctctccatcttccactgctttcgctttgatgcaaaccaaggaccaaaagtgtttgcaatacttgactgacgctgtcaccaagttcaacggtggtgttccaaacgtctacccagtcgacttgttcgaacacatctgggttgttgacagattgcaaagattaggtatctccagatacttcgactctgaaatcaaagactgtgtcgactacatctacagatactggaccaaggatggtatctgttgggctaagaactccaacgttcaagatattgatgacaccgctatgggtttcagagttttgagaatgcacggttacaaggtcactactgatgttttccgtcaattcgaaaaggacggtaaattcgtttgtttcccaggtcaaaccacccaagctgtcaccggtatgttcaacttgtttagagcttctcaagtcttgttcccagacgaaaagattttggaagatgctaagaaattctcttacaactacttgaaggaaaagcaatccaccaacgaattattggacaaatggatcattgccaaggacttgccaggtgaagttgaatacgctttagatgttccatggtacgcttccttgccacgtttggaaaccagattctacttggaacaatacggtggtgaagatgacgtctggatcggtaagactttgtacagaatgggtaatgtctccaacaacacctacttggaaatggccaaattggactacaacaactgtttggccattcatcacttggaatggaacaccatgcaacaatggtacgttgacttcggtatggaaagattcggtacttctgatatcacttctctattagtctcttactacttggctgctgcctccgtctttgaacctgaacgttctaaggaaagaattgcttgggctaagaccaccactttggttgacaccatctcttctttcttccactccttgaagatctctaacgaacaccgtcgtgaattcgttgaagaattcagaaacatctccaactccatccaccacgctaagtacggtaagccatggcacggtttgatggttgctttgaaaggtactttacacgaaattgccttggatgtcttgatgactcacagaagagacattcaccctcaattgcaccatgcttgggaaatgtggttgatgagatggcaacaaggtgtcgatgccactgaaggtcaagctgaattaattgttcaaaccatcaacatgactgctggtagatgggtttccaatgaattattggctcacccacaatacagattattgtcctctgtcatcaacaatatctgtcacgaaatctaccacaacagaacctgtatggaagtcaactctaccaccatttccacttctattgactccaagatgcaagaattggttcaattagtcttgtctgactctttggacgacttggaccaagatttgaagcaaaccttcttgactgttgccaagactttctactacaaggcttactgtgacccagaaaccatcaacgttcacatttctaaggtcatgttcgaaaccattatt

SEQ ID NO: 2 - protein, 799 aa, Lactuca sativa
MKTMISSPIPAFHPRFSPAAGSRRLSPILPSSGSVVLTGSKTQCKAVSKSPTQEYFDVLQKNGLPFINWQNDVVEDELDKEKKILYPNDEIKGFVERIKVMLGSMDEGEITVSAYDTAWVALVQDIDGNGRPEFPSSLEWIVKNQLSDGSWGDHLIFSAHDRIINTLACVIALTSWNVHPGKCQKGLKFLNDNISKLEEENPEHMPIGFEVAFPSLIDIARKLDIQVPEDSPALKEIYARRNLKLTKIPKSLMHKVPTTLLHSLEGMPDLEWEKLLKLQCKDGSFLFSPSSTAFALMQTKDQKCLQYLTDAVTKFNGGVPNVYPVDLFEHIWVVDRLQRLGISRYFDSEIKDCVDYIYRYWTKDGICWAKNSNVQDIDDTAMGFRVLRMHGYKVTTDVFRQFEKDGKFVCFPGQTTQAVTGMFNLFRASQVLFPDEKILEDAKKFSYNYLKEKQSTNELLDKWIIAKDLPGEVEYALDVPWYASLPRLETRFYLEQYGGEDDVWIGKTLYRMGNVSNNTYLEMAKLDYNNCLAIHHLEWNTMQQWYVDFGMERFGTSDITSLLVSYYLAAASVFEPERSKERIAWAKTTTLVDTISSFFHSLKISNEHRREFVEEFRNISNSIHHAKYGKPWHGLMVALKGTLHEIALDVLMTHRRDIHPQLHHAWEMWLMRWQQGVDATEGQAELIVQTINMTAGRWVSNELLAHPQYRLLSSVINNICHEIYHNRTCMEVNSTTISTSIDSKMQELVQLVLSDSLDDLDQDLKQTFLTVAKTFYYKAYCDPETINVHISKVMFETII

SEQ ID NO: 3 - DNA, 2271 bp, Lactuca sativa
  CDS (1)..(2271)
atgtgtaaggccgtttctaaatctccaactcaagaatactttgatgttttgcaaaagaacggtttgccattcatcaactggcaaaacgatgtcgttgaagatgaattggacaaggaaaagaagatcttgtacccaaacgacgaaatcaagggtttcgttgaaagaatcaaagttatgttaggttccatggacgaaggtgaaatcactgtctctgcttatgacaccgcttgggttgctttggtccaagatatcgatggtaacggtagaccagaatttccttcttctctagaatggatcgtcaagaaccaattatccgatggttcctggggtgaccatttgatcttctctgctcacgacagaatcattaacactttggcttgtgtcattgctttgacttcctggaacgttcatccaggtaagtgtcaaaagggtttaaagttcttgaacgacaacatctccaagttggaagaagaaaacccagaacacatgccaatcggttttgaagttgctttcccatctttgattgatattgccagaaagttggatatccaagttccagaagattccccagctttgaaggaaatttacgccagaagaaacttgaaattgaccaagattccaaagtctttgatgcacaaggttccaactactttgttgcattctttggaaggtatgccagacttggaatgggaaaagttgttgaagctacaatgtaaggatggttctttcttgttctctccatcttccactgctttcgctttgatgcaaaccaaggaccaaaagtgtttgcaatacttgactgacgctgtcaccaagttcaacggtggtgttccaaacgtctacccagtcgacttgttcgaacacatctgggttgttgacagattgcaaagattaggtatctccagatacttcgactctgaaatcaaagactgtgtcgactacatctacagatactggaccaaggatggtatctgttgggctaagaactccaacgttcaagatattgatgacaccgctatgggtttcagagttttgagaatgcacggttacaaggtcactactgatgttttccgtcaattcgaaaaggacggtaaattcgtttgtttcccaggtcaaaccacccaagctgtcaccggtatgttcaacttgtttagagcttctcaagtcttgttcccagacgaaaagattttggaagatgctaagaaattctcttacaactacttgaaggaaaagcaatccaccaacgaattattggacaaatggatcattgccaaggacttgccaggtgaagttgaatacgctttagatgttccatggtacgcttccttgccacgtttggaaaccagattctacttggaacaatacggtggtgaagatgacgtctggatcggtaagactttgtacagaatgggtaatgtctccaacaacacctacttggaaatggccaaattggactacaacaactgtttggccattcatcacttggaatggaacaccatgcaacaatggtacgttgacttcggtatggaaagattcggtacttctgatatcacttctctattagtctcttactacttggctgctgcctccgtctttgaacctgaacgttctaaggaaagaattgcttgggctaagaccaccactttggttgacaccatctcttctttcttccactccttgaagatctctaacgaacaccgtcgtgaattcgttgaagaattcagaaacatctccaactccatccaccacgctaagtacggtaagccatggcacggtttgatggttgctttgaaaggtactttacacgaaattgccttggatgtcttgatgactcacagaagagacattcaccctcaattgcaccatgcttgggaaatgtggttgatgagatggcaacaaggtgtcgatgccactgaaggtcaagctgaattaattgttcaaaccatcaacatgactgctggtagatgggtttccaatgaattattggctcacccacaatacagattattgtcctctgtcatcaacaatatctgtcacgaaatctaccacaacagaacctgtatggaagtcaactctaccaccatttccacttctattgactccaagatgcaagaattggttcaattagtcttgtctgactctttggacgacttggaccaagatttgaagcaaaccttcttgactgttgccaagactttctactacaaggcttactgtgacccagaaaccatcaacgttcacatttctaaggtcatgttcgaaaccattatt

SEQ ID NO: 4 - protein, 757 aa, Lactuca sativa
MCKAVSKSPTQEYFDVLQKNGLPFINWQNDVVEDELDKEKKILYPNDEIKGFVERIKVMLGSMDEGEITVSAYDTAWVALVQDIDGNGRPEFPSSLEWIVKNQLSDGSWGDHLIFSAHDRIINTLACVIALTSWNVHPGKCQKGLKFLNDNISKLEEENPEHMPIGFEVAFPSLIDIARKLDIQVPEDSPALKEIYARRNLKLTKIPKSLMHKVPTTLLHSLEGMPDLEWEKLLKLQCKDGSFLFSPSSTAFALMQTKDQKCLQYLTDAVTKFNGGVPNVYPVDLFEHIWVVDRLQRLGISRYFDSEIKDCVDYIYRYWTKDGICWAKNSNVQDIDDTAMGFRVLRMHGYKVTTDVFRQFEKDGKFVCFPGQTTQAVTGMFNLFRASQVLFPDEKILEDAKKFSYNYLKEKQSTNELLDKWIIAKDLPGEVEYALDVPWYASLPRLETRFYLEQYGGEDDVWIGKTLYRMGNVSNNTYLEMAKLDYNNCLAIHHLEWNTMQQWYVDFGMERFGTSDITSLLVSYYLAAASVFEPERSKERIAWAKTTTLVDTISSFFHSLKISNEHRREFVEEFRNISNSIHHAKYGKPWHGLMVALKGTLHEIALDVLMTHRRDIHPQLHHAWEMWLMRWQQGVDATEGQAELIVQTINMTAGRWVSNELLAHPQYRLLSSVINNICHEIYHNRTCMEVNSTTISTSIDSKMQELVQLVLSDSLDDLDQDLKQTFLTVAKTFYYKAYCDPETINVHISKVMFETII

SEQ ID NO: 5 - DNA, 2283 bp, Picea glauca
  CDS (1)..(2283)
atgaagatgtccaagtctgttgaagtccaacactgtgctgtccaattcttgtcttccaccaccgatcaaatcgaaatcagagaaagaaacttgcaaatctccactgaagccatgaagatgaaatcctggattgaaaccgtcaaatacattttgcaatccatggaagatggtgaaatcaccatctccgcttacgacactgcttggatcgccttggttccagctttgaacggttcctctgaacctcaattcccatcctctttacaatggttgatcaacaaccaattgcaagacggttcctggggtgacccattgatgttcttgattagagatcgtatcatcaacactttggcttgtgttttggctttgaagacctggaacattcactctttgggtgttaacaagggtctatctttcttgcaaacttacatccctaaaatgaacgatgaacatgatgctcacactccagttggtttcgaaattgtcttcccagctttgatggaagatgccaagatcatggaattggacttgccatacgacgctgaattcttgcaaaagatttacgatgaaagagatttgaagatgaagagaatcccaatgaaggttttgcacgaattcccatctactttattgcactccttggaaggtttgagagacaaggtcaactgggaagaattattgaagttgcaatccaagaacggttctttcttattctctccagcttctactgcttgtgctttggctcaaacttctgacaccaactgtttgagatacttgaatgaaatcaccaagaaatacgacggtggtgctccaaatgtttacccagtcgacttgttcgaaagattatggaccgtcgatcgtattgaaagattaggtattgctagatactttgaatctgaaatcactgactctttggaatacgtttacagatactggactaaccaaggtatcggttgggctagagattctccagttaaggacgtcgatgacacttccatggctttcagactattacgttcccacggtttcgacgttactgctgaagctttcaaccacttcaagcaagatgaccaattcttctgtttctttggtcaaaccaagcaaaccgtcactggtatgtacaacttgtacagagcttctcaattctccttcccaggtgaatctatcttagaagaagctcgtgtcttcaccaagaacttcttggaagaaaagagagctgaaaagcaattgagagacaaatggatcattgctaaaggtttgaaggaagaagtcgaatacgctttgaagttcccatggtatgcctcccaaccaagaattgacaccagaatgtacatcaaccaatacagagttgatgacgtctggatcggtaaggctctatacagaatgccaattgtcaacaacaagacctacatcgaattggccaaggctgacttcaacatttgtcaatctatccacagaactgaattgcacggtatcatcagatggtacagagaatccggtttggacgaattgggtttgagacaagaccaaatcgtcaaatcttacttcttggctgccattgctatctacgaaccagacatggcctctgccagattagcttgggctaagtctgctgtcttgatggctgctatcagaatcttcttttccggtgaaaactgttttgcccaccatagaagacaattcttggatgcctttaccagatgggacggtagagccatgagagattctccaaactccgctaagagattattctcttgtttattcagaatggttaacttgttctctgtcgacggtgttgttgctcaaggtagagacatctccggtgacttgagacacagatgggaacactggttggcctctgaagctgaagacttgaccgatgctcaagaccacgaaaagttgggtactgaagctgaaattgttgttttgactgctgctttcttgggtagagaaaccatttctccagatttgatttctcacccagatttctcttctattatgaaggttaccaacactgtttgttctttattgagaagaattgccacctacaaggaagaaggttgtgactccccatctggtactgaagaagatgacagattgaaacgtcgtgctgaagaaggtatgggtcatttggttcgtgccgtttacagacaccaatactctccagttccatctggtgtcaagagattgtgtttggttgttggtaagtccttttactacgctgctcactgtaacaatgaagaagttggtaaccatgtcgaaaccgtcttgttccaaccagtatac

SEQ ID NO: 6 - protein, 761 aa, Picea glauca
MKMSKSVEVQHCAVQFLSSTTDQIEIRERNLQISTEAMKMKSWIETVKYILQSMEDGEITISAYDTAWIALVPALNGSSEPQFPSSLQWLINNQLQDGSWGDPLMFLIRDRIINTLACVLALKTWNIHSLGVNKGLSFLQTYIPKMNDEHDAHTPVGFEIVFPALMEDAKIMELDLPYDAEFLQKIYDERDLKMKRIPMKVLHEFPSTLLHSLEGLRDKVNWEELLKLQSKNGSFLFSPASTACALAQTSDTNCLRYLNEITKKYDGGAPNVYPVDLFERLWTVDRIERLGIARYFESEITDSLEYVYRYWTNQGIGWARDSPVKDVDDTSMAFRLLRSHGFDVTAEAFNHFKQDDQFFCFFGQTKQTVTGMYNLYRASQFSFPGESILEEARVFTKNFLEEKRAEKQLRDKWIIAKGLKEEVEYALKFPWYASQPRIDTRMYINQYRVDDVWIGKALYRMPIVNNKTYIELAKADFNICQSIHRTELHGIIRWYRESGLDELGLRQDQIVKSYFLAAIAIYEPDMASARLAWAKSAVLMAAIRIFFSGENCFAHHRRQFLDAFTRWDGRAMRDSPNSAKRLFSCLFRMVNLFSVDGVVAQGRDISGDLRHRWEHWLASEAEDLTDAQDHEKLGTEAEIVVLTAAFLGRETISPDLISHPDFSSIMKVTNTVCSLLRRIATYKEEGCDSPSGTEEDDRLKRRAEEGMGHLVRAVYRHQYSPVPSGVKRLCLVVGKSFYYAAHCNNEEVGNHVETVLFQPVY

SEQ ID NO: 7 - DNA, 1548 bp, Bradyrhizobium japonicum
  CDS (1)..(1548)
atgaacgctttgtctgaacacatcttatctgaattgagaagattattgtccgaaatgtctgacggtggttccgtcggtccttccgtttacgacaccgcccaagccttgagattccacggtaacgtcactggtagacaagatgcttacgcttggttgattgctcaacaacaagctgacggtggttggggttctgctgatttcccattattcagacatgccccaacctgggctgctctattggctttgcaaagagctgacccattgccaggtgctgctgatgccgtccaaaccgccaccagattcttgcaaagacaaccagacccatacgctcatgccgttccagaagatgctccaatcggtgctgaattgatcttgcctcaattctgtggtgaagctgcttctctattaggtggtgttgccttcccaagacacccagctttgttgccattgagacaagcttgtttggtcaaattgggtgccgttgccatgttgccatctggtcacccattgttgcactcctgggaagcctggggtacttctccaactactgcttgtccagacgatgacggttccatcggtatctctccagctgctactgctgcttggagagcccaagccgttaccagaggttccactccacaagtcggtagagctgatgcttacttgcaaatggcttccagagccaccagatctggtattgaaggtgttttcccaaatgtctggccaatcaacgtctttgaaccatgttggtctttgtacactttgcacttggctggtttgtttgctcatccagctttggctgaagccgtcagagtcattgttgctcaattggatgctagattaggtgtccacggtttaggtccagctttgcacttcgctgctgacgctgatgacaccgccgttgctctatgtgttttgcacttggctggtcgtgacccagctgttgacgctttgagacacttcgaaattggtgaattgttcgtcactttcccaggtgaaagaaacgcttctgtttccaccaacatccacgctttgcacgctttgagattgttgggtaagccagctgctggtgcttctgcttacgttgaagccaacagaaacccacacggtttatgggacaacgaaaagtggcacgtttcctggttatacccaactgctcacgccgttgctgctttggcccaaggtaagcctcaatggagagatgaaagagctttggccgctttgttgcaagctcaaagagatgacggtggttggggtgctggtcgtggttctactttcgaagaaaccgcctacgctttgtttgctttgcatgtcatggacggttctgaagaagctaccggtagaagaagaattgctcaagttgttgccagagctttggaatggatgttggctcgtcacgctgcccacggtttgccacaaactccattatggatcggtaaggaattgtactgtccaaccagagttgtcagagttgctgaattggctggtttatggttggctttgagatggggtcgtcgtgtcttggctgaaggtgctggtgctgcaccc

SEQ ID NO: 8 - protein, 516 aa, Bradyrhizobium japonicum
MNALSEHILSELRRLLSEMSDGGSVGPSVYDTAQALRFHGNVTGRQDAYAWLIAQQQADGGWGSADFPLFRHAPTWAALLALQRADPLPGAADAVQTATRFLQRQPDPYAHAVPEDAPIGAELILPQFCGEAASLLGGVAFPRHPALLPLRQACLVKLGAVAMLPSGHPLLHSWEAWGTSPTTACPDDDGSIGISPAATAAWRAQAVTRGSTPQVGRADAYLQMASRATRSGIEGVFPNVWPINVFEPCWSLYTLHLAGLFAHPALAEAVRVIVAQLDARLGVHGLGPALHFAADADDTAVALCVLHLAGRDPAVDALRHFEIGELFVTFPGERNASVSTNIHALHALRLLGKPAAGASAYVEANRNPHGLWDNEKWHVSWLYPTAHAVAALAQGKPQWRDERALAALLQAQRDDGGWGAGRGSTFEETAYALFALHVMDGSEEATGRRRIAQVVARALEWMLARHAAHGLPQTPLWIGKELYCPTRVVRVAELAGLWLALRWGRRVLAEGAGAAP

SEQ ID NO: 9 - DNA, 2364 bp, Lactuca sativa
  CDS (1)..(2364)
atgaacattgctcaaatcacctcttctgctatgttggttccatcttctcacatcccacaccgttcctgggttgtcaactgttgtatggttcaatacaacccatccggtctaagaactgcttcctctcaagccggtcaagtcaacccaactgttatgactttggatgtcactaaggaaagaatcagaaagttgttcaacaacgtcgaagtttctgtttcctcttacgacaccgcttgggttgccatggttccatctccaaactctccaaagtccccatgtttcccagactgtttgaactggttgttggacaaccaattggatgatggttcctggggtttgttgccacaccaatctccattgatcaaagacactttatcttctactttggcttgtgttttggctttaaagagatggaacgtcggtaaggatcaaatcaacaagggtttacattacatcgaatccaactttgcttccgtcactgataagaaccaagcctctccattcggttttgacatcattttcccaggtatgttggaatacgccaaggatttggacattaaattgcctttgaaccaaactcacttgtccgtcatgttgcacgaaagagaattggaattgagaagatgtcactctaacggtcgtgaagcctacttagcttacatttccgaaggtttgggtaacttgaacgactggaacatggttatgaagtaccaaatgaagaacggttctttgttcaactctccttctgctactgcttctgttttgattcaccaccaaaatgctggttgtttgcactacttaacctccctattggacaagtttggtaatgctgtcccaactgtttacccaatcgacttgtacgttagattgtccatggttgacactttggaaagattgggtatcaagagacatttcatggttgaaattcaaaatgtcttggacgaaacctacagatgttgggttcaaggtgatgttcaaatcttcatggatgtcgttacctgtgctttggctttcagagttctacgttctaacggttacgaagtctcttctgacccattggctaagattaccaaagaaggtgactacatgaactctccagaaaagcctttcaaggacgtctacacctctttggaagtctacaaggcttctcaaatcatctaccaagaagaattggccttcagagaacaaaacttgacctcttatttgccatcttctaacaaattgtccaactacattttgaaggaagttgatgacgctttgaagttcccattcaatggttctctagaaagaatgtccactagaagaaacattgaacactacaacttgaaccacaccagaattttgaagaccacctactcctcttccaacatttccaacaaggactacttgaaattagccgtccaagacttcaacgaatgtcaatccatctactgtgaagaattaaaggacttggaaagatgggttgtcgaaaacagattagacaagttgaaatttgctcgtcaaaagaccgcttactgttacttctctgctgcttctttcttatcttctccagatttgtccgatgctagaatctcctgggctaaatcttccattttgactaccgtcattgatgatttctttgacgtcggtggttccatggatgaattggttaacttcgtccacatcatcgaaaagtggaacgtcaacgttgaaaacgattgttgttctgaagaagtcggtgttttgttcttggctttaaaggatgctgtctgttggattggtgacaaggctttcaagatccaagaaagaaacatcacttcccacgtcattgaaatctggttggacttggttaagtccatgttgagagaagctatttgggctaaggacggttccatcccaaccatcaacgaatacatggaaaacggttacgtttctttcgccttgggtccaatcgttttgccaactttgtacttcttaggtgtcaagttgtctgaagaagtcgtccaatcttccgaataccacaagttgtacgaagttatgtccacccaaggtagattgatgaacgacattcactctttcaaacgtgaaaagaaggccggtaagttgaatgctgttgctttatacatgtccgacggtaaatctggttctgttgaagaagaagttgtcgaagaaatgaagatcttgactaaatctcaaagaaaggaaatgatgaagttggttttggaaaccaagggttccgttgtcccaagagtttgtaaggacgttttctggaacatgtgtaacgtcttgaacttgttctacgctaccgatgacggtttcactggtaacgccatcttagatgttgtcaaggaaatcatctacgaaccagtctctcatgaattgata

SEQ ID NO: 10 - protein, 788 aa, Lactuca sativa
MNIAQITSSAMLVPSSHIPHRSWVVNCCMVQYNPSGLRTASSQAGQVNPTVMTLDVTKERIRKLFNNVEVSVSSYDTAWVAMVPSPNSPKSPCFPDCLNWLLDNQLDDGSWGLLPHQSPLIKDTLSSTLACVLALKRWNVGKDQINKGLHYIESNFASVTDKNQASPFGFDIIFPGMLEYAKDLDIKLPLNQTHLSVMLHERELELRRCHSNGREAYLAYISEGLGNLNDWNMVMKYQMKNGSLFNSPSATASVLIHHQNAGCLHYLTSLLDKFGNAVPTVYPIDLYVRLSMVDTLERLGIKRHFMVEIQNVLDETYRCWVQGDVQIFMDVVTCALAFRVLRSNGYEVSSDPLAKITKEGDYMNSPEKPFKDVYTSLEVYKASQIIYQEELAFREQNLTSYLPSSNKLSNYILKEVDDALKFPFNGSLERMSTRRNIEHYNLNHTRILKTTYSSSNISNKDYLKLAVQDFNECQSIYCEELKDLERWVVENRLDKLKFARQKTAYCYFSAASFLSSPDLSDARISWAKSSILTTVIDDFFDVGGSMDELVNFVHIIEKWNVNVENDCCSEEVGVLFLALKDAVCWIGDKAFKIQERNITSHVIEIWLDLVKSMLREAIWAKDGSIPTINEYMENGYVSFALGPIVLPTLYFLGVKLSEEVVQSSEYHKLYEVMSTQGRLMNDIHSFKREKKAGKLNAVALYMSDGKSGSVEEEVVEEMKILTKSQRKEMMKLVLETKGSVVPRVCKDVFWNMCNVLNLFYATDDGFTGNAILDVVKEIIYEPVSHELI

SEQ ID NO: 11 - DNA, 2250 bp, Lactuca sativa
  CDS (1)..(2250)
atggcttcctctcaagccggtcaagtcaacccaactgttatgactttggatgtcactaaggaaagaatcagaaagttgttcaacaacgtcgaagtttctgtttcctcttacgacaccgcttgggttgccatggttccatctccaaactctccaaagtccccatgtttcccagactgtttgaactggttgttggacaaccaattggatgatggttcctggggtttgttgccacaccaatctccattgatcaaagacactttatcttctactttggcttgtgttttggctttaaagagatggaacgtcggtaaggatcaaatcaacaagggtttacattacatcgaatccaactttgcttccgtcactgataagaaccaagcctctccattcggttttgacatcattttcccaggtatgttggaatacgccaaggatttggacattaaattgcctttgaaccaaactcacttgtccgtcatgttgcacgaaagagaattggaattgagaagatgtcactctaacggtcgtgaagcctacttagcttacatttccgaaggtttgggtaacttgaacgactggaacatggttatgaagtaccaaatgaagaacggttctttgttcaactctccttctgctactgcttctgttttgattcaccaccaaaatgctggttgtttgcactacttaacctccctattggacaagtttggtaatgctgtcccaactgtttacccaatcgacttgtacgttagattgtccatggttgacactttggaaagattgggtatcaagagacatttcatggttgaaattcaaaatgtcttggacgaaacctacagatgttgggttcaaggtgatgttcaaatcttcatggatgtcgttacctgtgctttggctttcagagttctacgttctaacggttacgaagtctcttctgacccattggctaagattaccaaagaaggtgactacatgaactctccagaaaagcctttcaaggacgtctacacctctttggaagtctacaaggcttctcaaatcatctaccaagaagaattggccttcagagaacaaaacttgacctcttatttgccatcttctaacaaattgtccaactacattttgaaggaagttgatgacgctttgaagttcccattcaatggttctctagaaagaatgtccactagaagaaacattgaacactacaacttgaaccacaccagaattttgaagaccacctactcctcttccaacatttccaacaaggactacttgaaattagccgtccaagacttcaacgaatgtcaatccatctactgtgaagaattaaaggacttggaaagatgggttgtcgaaaacagattagacaagttgaaatttgctcgtcaaaagaccgcttactgttacttctctgctgcttctttcttatcttctccagatttgtccgatgctagaatctcctgggctaaatcttccattttgactaccgtcattgatgatttctttgacgtcggtggttccatggatgaattggttaacttcgtccacatcatcgaaaagtggaacgtcaacgttgaaaacgattgttgttctgaagaagtcggtgttttgttcttggctttaaaggatgctgtctgttggattggtgacaaggctttcaagatccaagaaagaaacatcacttcccacgtcattgaaatctggttggacttggttaagtccatgttgagagaagctatttgggctaaggacggttccatcccaaccatcaacgaatacatggaaaacggttacgtttctttcgccttgggtccaatcgttttgccaactttgtacttcttaggtgtcaagttgtctgaagaagtcgtccaatcttccgaataccacaagttgtacgaagttatgtccacccaaggtagattgatgaacgacattcactctttcaaacgtgaaaagaaggccggtaagttgaatgctgttgctttatacatgtccgacggtaaatctggttctgttgaagaagaagttgtcgaagaaatgaagatcttgactaaatctcaaagaaaggaaatgatgaagttggttttggaaaccaagggttccgttgtcccaagagtttgtaaggacgttttctggaacatgtgtaacgtcttgaacttgttctacgctaccgatgacggtttcactggtaacgccatcttagatgttgtcaaggaaatcatctacgaaccagtctctcatgaattgata

SEQ ID NO: 12 - protein, 750 aa, Lactuca sativa
MASSQAGQVNPTVMTLDVTKERIRKLFNNVEVSVSSYDTAWVAMVPSPNSPKSPCFPDCLNWLLDNQLDDGSWGLLPHQSPLIKDTLSSTLACVLALKRWNVGKDQINKGLHYIESNFASVTDKNQASPFGFDIIFPGMLEYAKDLDIKLPLNQTHLSVMLHERELELRRCHSNGREAYLAYISEGLGNLNDWNMVMKYQMKNGSLFNSPSATASVLIHHQNAGCLHYLTSLLDKFGNAVPTVYPIDLYVRLSMVDTLERLGIKRHFMVEIQNVLDETYRCWVQGDVQIFMDVVTCALAFRVLRSNGYEVSSDPLAKITKEGDYMNSPEKPFKDVYTSLEVYKASQIIYQEELAFREQNLTSYLPSSNKLSNYILKEVDDALKFPFNGSLERMSTRRNIEHYNLNHTRILKTTYSSSNISNKDYLKLAVQDFNECQSIYCEELKDLERWVVENRLDKLKFARQKTAYCYFSAASFLSSPDLSDARISWAKSSILTTVIDDFFDVGGSMDELVNFVHIIEKWNVNVENDCCSEEVGVLFLALKDAVCWIGDKAFKIQERNITSHVIEIWLDLVKSMLREAIWAKDGSIPTINEYMENGYVSFALGPIVLPTLYFLGVKLSEEVVQSSEYHKLYEVMSTQGRLMNDIHSFKREKKAGKLNAVALYMSDGKSGSVEEEVVEEMKILTKSQRKEMMKLVLETKGSVVPRVCKDVFWNMCNVLNLFYATDDGFTGNAILDVVKEIIYEPVSHELI

SEQ ID NO: 13 - DNA, 2271 bp, Picea glauca
  CDS (1)..(2271)
atgaagagagaacaatacactatcttgaacgaaaaggaatccatggctgaagaattaatcttgagaatcaagagaatgttttctgaaatcgaaaacactcaaacctctgcttctgcttacgacaccgcttgggttgccatggttccatctttggactcctctcaacaaccacaattccctcaatgtttgtcctggatcattgacaaccaattgttggatggttcctggggtatcccatacttgatcatcaaggacagactatgtcacactttagcttgtgtcattgctttgagaaaatggaacgctggtaaccaaaatgtcgaaaccggtctacgtttcttgagagaaaacattgaaggtatcgttcacgaagatgaatacactccaattggtttccaaatcattttcccagctatgttggaagaagctcgtggtttaggtctagaattgccatacgacttgactccaatcaagttgatgttgacccacagagaaaagatcatgaagggtaaggccattgaccacatgcacgaatacgactcttctttgatctacactgttgaaggtatccacaagatcgttgactggaacaaggttttgaaacatcaaaacaaggatggttctttgttcaactctccatctgctactgcttgtgctttgatgcacactagaaagtccaactgtttggaatacttgtcctccatgttgcaaaagttaggtaacggtgttccatccgtctacccaatcaacttatatgctcgtatctccatgattgacagattacaaagattaggtttggctagacatttcagaaacgaaatcattcacgctttggacgacatctacagatactggatgcaaaaggaaacctccagagaaggtaagtctttgaccccagatattgtctctacttccatcgctttcatgttgttgagattgcacggttacgatgttccagctgatgttttctgttgttaccatttgcactccattgaacaatctggtgaagccgttactgctatgttgtctttgtacagagcctctcaaattatgttcccaggtgaaaccattttggaagaaatcaagaccgtttctagaaagtacttggacaagagaaaggaaaacggtcgtatctactaccacaacattgttatgaaggacttgagaggtgaagtcgaatacgccttgtctgttccatggtacgcttccttggaaagaattgaaaacagaagatacattgaccaatacggtgtcaacgatacctggatcgctaagacctcttacaaaatcccatgtatctccaatgacttattcttggctttggccaagcaagactacaacatctgtcaagccattcaacaaaaggaattgagagaattggaaagatggtttgctgataacaaattctctcacttgaacttcgctcgtcaaaagttgatctactgttacttctctgccgctgctactttgttctctccagaattgtctgctgccagagttgtctgggctaagaacggtgttatcaccaccgtcgttgatgacttcttcgatgtcggtggttcttctgaagaaattcactctttcgtcgaagctgttagagtctgggacgaagctgctaccgatggtttgtctgaaaacgttcaaatcttattctccgctttatacaacaccgtcgacgaaattgtccaacaagccttcgttttccaaggtagagacatctccattcacttgagagaaatctggtacagattggtcaactccatgatgactgaagctcaatgggctagaactcactgtattccatccatgcacgaatacatggaaaacgctgaaccttctattgctttggaaccaatcgtcttgtcctctttatactttgttggtccaaagttgtctgaagaaatcatttgtcacccagaatactacaacttgatgcatttgttgaatatctgtggtagattgttgaacgatatccaaggttgtaaacgtgaagcccaccaaggtaagttgaactccgtcactttgtacatggaagaaaactctggtactaccatggaagatgctatcgtttacttgagaaagaccatcgacgaatccagacaattgctattgaaagaagttttaagaccatctattgttccaagagaatgtaaacaattgcactggaacatgatgagaatcttgcaattgttctacttgaagaacgatggttttacctctccaactgaaatgttgggttacgtcaacgccgtcattgtcgacccaattttg

SEQ ID NO: 14 - protein, 757 aa, Picea glauca
MKREQYTILNEKESMAEELILRIKRMFSEIENTQTSASAYDTAWVAMVPSLDSSQQPQFPQCLSWIIDNQLLDGSWGIPYLIIKDRLCHTLACVIALRKWNAGNQNVETGLRFLRENIEGIVHEDEYTPIGFQIIFPAMLEEARGLGLELPYDLTPIKLMLTHREKIMKGKAIDHMHEYDSSLIYTVEGIHKIVDWNKVLKHQNKDGSLFNSPSATACALMHTRKSNCLEYLSSMLQKLGNGVPSVYPINLYARISMIDRLQRLGLARHFRNEIIHALDDIYRYWMQKETSREGKSLTPDIVSTSIAFMLLRLHGYDVPADVFCCYHLHSIEQSGEAVTAMLSLYRASQIMFPGETILEEIKTVSRKYLDKRKENGRIYYHNIVMKDLRGEVEYALSVPWYASLERIENRRYIDQYGVNDTWIAKTSYKIPCISNDLFLALAKQDYNICQAIQQKELRELERWFADNKFSHLNFARQKLIYCYFSAAATLFSPELSAARVVWAKNGVITTVVDDFFDVGGSSEEIHSFVEAVRVWDEAATDGLSENVQILFSALYNTVDEIVQQAFVFQGRDISIHLREIWYRLVNSMMTEAQWARTHCIPSMHEYMENAEPSIALEPIVLSSLYFVGPKLSEEIICHPEYYNLMHLLNICGRLLNDIQGCKREAHQGKLNSVTLYMEENSGTTMEDAIVYLRKTIDESRQLLLKEVLRPSIVPRECKQLHWNMMRILQLFYLKNDGFTSPTEMLGYVNAVIVDPIL

SEQ ID NO: 15 - DNA, 900 bp, Bradyrhizobium japonicum
  CDS (1)..(900)
atgatccaaactgaaagagctgtccaacaagttttggaatggggtcgttctttgaccggtttcgctgacgaacacgctgtcgaagctgttcgtggtggtcaatacatcttacaaagaatccacccatctttgagaggtacttctgccagaactggtagagatccacaagatgaaactttgattgtcaccttttacagagaattggctttgttgttctggttagatgactgtaacgatttgggtttgatttccccagaacaattggctgctgtcgaacaagctttgggtcaaggtgtcccatgtgctttgccaggtttcgaaggttgtgccgttttgagagcttctttggccactttggcctacgacagaagagactacgctcaattgttggatgacaccagatgttactccgctgctttgagagctggtcatgcccaagctgttgctgctgaaagatggtcctacgctgaatacttgcacaacggtattgactccattgcttacgctaacgttttctgttgtttgtccctattatggggtttggacatggctactttgagagccagaccagctttcagacaagtcttgagattaatctctgccattggtagattacaaaacgatttgcacggttgtgacaaggaccgttctgctggtgaagctgacaacgctgtcatcttattgttgcaaagatacccagccatgccagttgttgaattcttgaacgatgaattggctggtcacaccagaatgttgcaccgtgtcatggctgaagaaagattcccagctccatggggtccattaatcgaagctatggctgccatcagagttcaatactacagaacctccacctctcgttacagatctgacgctgttagaggtggtcaaagagcccctgcc

SEQ ID NO: 16 - protein, 300 aa, Bradyrhizobium japonicum
MIQTERAVQQVLEWGRSLTGFADEHAVEAVRGGQYILQRIHPSLRGTSARTGRDPQDETLIVTFYRELALLFWLDDCNDLGLISPEQLAAVEQALGQGVPCALPGFEGCAVLRASLATLAYDRRDYAQLLDDTRCYSAALRAGHAQAVAAERWSYAEYLHNGIDSIAYANVFCCLSLLWGLDMATLRARPAFRQVLRLISAIGRLQNDLHGCDKDRSAGEADNAVILLLQRYPAMPVVEFLNDELAGHTRMLHRVMAEERFPAPWGPLIEAMAAIRVQYYRTSTSRYRSDAVRGGQRAPA

SEQ ID NO: 17 - DNA, 2838 bp, Phaeosphaeria sp.
  CDS (1)..(2838)
atgtttgctaagtttgatatgttggaagaagaagctagagctttggtcagaaaggtcggtaacgctgttgacccaatctacggtttctctaccacttcctgtcaaatctacgacaccgcttgggctgctatgatctccaaggaagaacacggtgacaaggtctggttgttcccagaatctttcaaatacttgttggaaaagcaaggtgaagatggttcctgggaaagacatccaagatccaagactgtcggtgttttgaacactgctgccgcttgtttggccttgttgagacacgtcaagaaccctttgcaattgcaagacattgctgcccaagacatcgaattgagaatccaaagaggtttgcgttctttggaagaacaattgattgcttgggatgatgtcttggacaccaaccacatcggtgtcgaaatgattgttccagctttgttggactacttgcaagccgaagatgaaaacgttgactttgaattcgaatcccactctctattgatgcaaatgtacaaagaaaagatggccagattctccccagaatccttatacagagctagaccatcttctgccttacataatttggaagctttgatcggtaaattggactttgacaaggttggtcaccacttgtacaacggttccatgatggcttccccatcttccactgctgcctttctaatgcatgcctctccatggtcccacgaagctgaagcttacctacgtcacgttttcgaagctggtactggtaagggttccggtggtttcccaggtacttacccaaccacttacttcgaattgaactgggttttgtccactttgatgaaatctggtttcactttatctgatttggaatgtgatgaattatcttccattgccaacaccattgctgaaggtttcgaatgtgaccacggtgtcatcggttttgctccaagagctgtcgatgtcgacgacaccgctaagggtttgttgactttaactttattaggtatggatgaaggtgtttctccagctccaatgattgctatgttcgaagccaaggaccacttcttgactttcttgggtgaacgtgacccatctttcacttctaactgtcacgttttgttatctttgttgcacagaaccgatttgttgcaatatttgcctcaaatcagaaagaccaccaccttcttgtgtgaagcctggtgggcttgtgacggtcaaatcaaggacaaatggcacttatctcacttgtacccaaccatgttgatggtccaagctttcgctgaaatcttattgaagtctgctgaaggtgaaccattgcacgatgctttcgatgccgctactttgtccagagtctccatttgtgttttccaagcttgtttgagaactctattggcccaatctcaagatggttcttggcacggtcaaccagaagcttcttgttacgctgtcttgactttggctgaatctggtcgtttggttttgttgcaagctttgcaaccacaaatcgctgctgccatggaaaaggccgctgatgttatgcaagctggtagatggtcctgttctgatcatgactgtgactggacctccaagaccgcttacagagttgacttagttgctgctgcttacagattagctgctatgaaagcttcttccaacttgactttcaccgtcgatgacaacgtttccaagagatccaacggtttccaacaattggtcggtagaactgacttgttctctggtgtcccagcctgggaattacaagcttctttcttggaatctgctttgttcgttcctttgttgagaaaccatagattggatgttttcgacagagatgacatcaaggtttctaaggaccactacttggacatgatcccattcacctgggttggttgtaacaacagatctagaacctacgtttctacctctttcttgttcgacatgatgatcatctccatgttgggttaccaaatcgatgaattcttcgaagctgaagctgctccagctttcgctcaatgtattggtcaattgcaccaagtcgtcgacaaggttgttgatgaagtcattgacgaagtcgtcgataaggttgtcggtaaggtcgttggtaaggttgttggtaaggttgtcgacgaacgtgttgactctccaacccacgaagccattgccatctgtaacatcgaagcttctttaagaagattcgtcgatcacgttttgcaccaccaacatgtcttacacgcttctcaacaagaacaagacattttgtggagagaattgagagccttcttgcacgctcacgttgtccaaatggccgacaactccactttggctccaccaggtagaactttcttcgactgggttagaaccactgctgctgaccacgttgcctgtgcttactctttcgctttcgcttgttgtatcacctctgctactatcggtcaaggtcaatctatgttcgctaccgtcaacgaattgtacttggtccaagctgctgctcgtcacatgaccaccatgtgtagaatgtgtaacgacattggttccgtcgacagagatttcatcgaagctaacattaactccgttcacttcccagaattctccactttgtctttggttgctgacaagaagaaagctttggccagattggctgcctacgaaaagtcttgtttgactcacactttggaccaatttgaaaatgaagttttacaatctccacgtgtttcttctgctgcctccggtgatttcagaaccagaaaggttgccgttgttagattctttgctgatgtcactgacttctacgatcaattgtacattttgagagatttgtcctcttctttgaagcatgtcggaacc

SEQ ID NO: 18 - protein, 946 aa, Phaeosphaeria sp.
MFAKFDMLEEEARALVRKVGNAVDPIYGFSTTSCQIYDTAWAAMISKEEHGDKVWLFPESFKYLLEKQGEDGSWERHPRSKTVGVLNTAAACLALLRHVKNPLQLQDIAAQDIELRIQRGLRSLEEQLIAWDDVLDTNHIGVEMIVPALLDYLQAEDENVDFEFESHSLLMQMYKEKMARFSPESLYRARPSSALHNLEALIGKLDFDKVGHHLYNGSMMASPSSTAAFLMHASPWSHEAEAYLRHVFEAGTGKGSGGFPGTYPTTYFELNWVLSTLMKSGFTLSDLECDELSSIANTIAEGFECDHGVIGFAPRAVDVDDTAKGLLTLTLLGMDEGVSPAPMIAMFEAKDHFLTFLGERDPSFTSNCHVLLSLLHRTDLLQYLPQIRKTTTFLCEAWWACDGQIKDKWHLSHLYPTMLMVQAFAEILLKSAEGEPLHDAFDAATLSRVSICVFQACLRTLLAQSQDGSWHGQPEASCYAVLTLAESGRLVLLQALQPQIAAAMEKAADVMQAGRWSCSDHDCDWTSKTAYRVDLVAAAYRLAAMKASSNLTFTVDDNVSKRSNGFQQLVGRTDLFSGVPAWELQASFLESALFVPLLRNHRLDVFDRDDIKVSKDHYLDMIPFTWVGCNNRSRTYVSTSFLFDMMIISMLGYQIDEFFEAEAAPAFAQCIGQLHQVVDKVVDEVIDEVVDKVVGKVVGKVVGKVVDERVDSPTHEAIAICNIEASLRRFVDHVLHHQHVLHASQQEQDILWRELRAFLHAHVVQMADNSTLAPPGRTFFDWVRTTAADHVACAYSFAFACCITSATIGQGQSMFATVNELYLVQAAARHMTTMCRMCNDIGSVDRDFIEANINSVHFPEFSTLSLVADKKKALARLAAYEKSCLTHTLDQFENEVLQSPRVSSAASGDFRTRKVAVVRFFADVTDFYDQLYILRDLSSSLKHVGT

SEQ ID NO: 19 - DNA, 2856 bp, Gibberella fujikuroi
  CDS (1)..(2856)
atgccaggtaagatcgaaaacggtactccaaaggatttaaagactggtaacgatttcgtttctgctgccaagtctttgttggacagagctttcaaatctcaccactcttactacggtttatgttccacttcttgtcaagtttacgacactgcttgggttgccatgatcccaaagaccagagataatgtcaaacaatggttgttccctgaatgtttccactacttgttgaaaacccaagctgctgatggttcctggggttctttgccaaccactcaaaccgctggtatcttggataccgcttccgctgtcttggctttgctatgtcacgctcaagaaccattgcaaatcttggatgtttctccagatgaaatgggtttgagaatcgaacacggtgttacttctttgaagagacaattggctgtctggaacgacgtcgaggacactaaccacattggtgtcgaatttattattccagctttattgtccatgttggaaaaggaattggatgttccatctttcgaattcccatgtagatccatcttggaaagaatgcacggtgaaaagttgggtcacttcgatttggaacaagtctacggtaagccatcttctttactacattctttggaagctttcttaggtaagttagacttcgacagattgtcccaccacttgtaccacggttccatgatggcttctccatcctccactgctgcctacttgattggtgctaccaaatgggatgacgaagctgaggactacttgagacacgttatgagaaacggtgctggtcatggtaacggtggtatctccggtactttcccaaccacccatttcgaatgttcctggatcattgccactttgttgaaggttggtttcaccttgaaacaaattgacggtgacggtttgagaggtctatccactatcttattggaagctttacgtgacgaaaacggtgtcatcggtttcgctccaagaaccgctgatgtcgacgacaccgccaaggctttgttggctttgtctttagttaaccaacctgtctctccagatatcatgattaaggttttcgaaggtaaggaccattttaccactttcggttctgaacgtgatccatctttgacctctaacttgcacgtcttgttgtctttgttgaagcaatctaacttgtctcaataccatccacaaatcttaaagactactttgtttacctgtagatggtggtggggttctgaccattgtgtcaaggacaagtggaacttgtctcatttgtacccaaccatgttgttggtcgaagccttcactgaagtcttgcacttgattgacggtggtgaattgtcctctttgttcgatgaatctttcaaatgtaagatcggtttgtccattttccaagctgttttgagaatcatcttgactcaagacaacgatggttcctggagaggttacagagaacaaacctgttacgccattttggctttggtccaagctcgtcacgtttgtttcttcactcacatggtcgatagattacaatcttgtgtcgacagaggtttctcctggttaaagtcttgttccttccactctcaagacttgacttggacctccaagactgcttacgaagttggtttcgttgctgaagcctacaaattggctgctttgcaatctgcttctttggaagttccagctgctaccatcggtcactccgttacctctgctgtcccatcttctgacttggaaaagtacatgagattggtccgtaagactgctttgttctctccattggacgaatggggtttgatggcttccattattgaatcttctttctttgtcccattgttgcaagctcaaagagtcgaaatctacccaagagataatatcaaggttgacgaggacaagtacttgtccatcattccatttacctgggttggttgtaataacagatctagaactttcgcttctaacagatggttatatgacatgatgtacttatctttgttgggttaccaaactgacgaatacatggaagctgttgccggtccagttttcggtgatgtttctctattgcaccaaaccatcgacaaggttatcgacaacaccatgggtaacttggccagagccaacggtactgttcactctggtaacggtcaccaacacgaatctccaaacattggtcaagttgaggacactttgaccagattcaccaactccgttttgaaccacaaggacgtcttgaactcttcttcttctgaccaagataccttacgtcgtgaattcagaactttcatgcacgctcacatcacccaaatcgaagataactccagattctccaagcaagcctcctctgatgccttttcttctccagaacaatcttacttccaatgggttaactccactggtggttctcacgttgcttgtgcctactccttcgccttttccaactgtttgatgtccgctaacttattgcaaggtaaggatgctttcccatctggtactcaaaagtacttgatctcctccgtcatgagacacgctaccaacatgtgtcgtatgtacaacgatttcggttctattgccagagacaacgctgaaagaaacgttaactccattcacttccctgaattcactctatgtaacggtacttctcaaaacttggatgaaagaaaggaaagattattgaagatcgctacctacgaacaaggttacttggacagagctttggaagctttggaaagacaatccagagatgacgctggtgacagagctggttccaaggacatgagaaaattgaagattgtcaaattgttctgtgatgttaccgacttgtacgaccaattgtacgtcatcaaggacttgtcctcttccatgaag

SEQ ID NO: 20 - protein, 952 aa, Gibberella fujikuroi
MPGKIENGTPKDLKTGNDFVSAAKSLLDRAFKSHHSYYGLCSTSCQVYDTAWVAMIPKTRDNVKQWLFPECFHYLLKTQAADGSWGSLPTTQTAGILDTASAVLALLCHAQEPLQILDVSPDEMGLRIEHGVTSLKRQLAVWNDVEDTNHIGVEFIIPALLSMLEKELDVPSFEFPCRSILERMHGEKLGHFDLEQVYGKPSSLLHSLEAFLGKLDFDRLSHHLYHGSMMASPSSTAAYLIGATKWDDEAEDYLRHVMRNGAGHGNGGISGTFPTTHFECSWIIATLLKVGFTLKQIDGDGLRGLSTILLEALRDENGVIGFAPRTADVDDTAKALLALSLVNQPVSPDIMIKVFEGKDHFTTFGSERDPSLTSNLHVLLSLLKQSNLSQYHPQILKTTLFTCRWWWGSDHCVKDKWNLSHLYPTMLLVEAFTEVLHLIDGGELSSLFDESFKCKIGLSIFQAVLRIILTQDNDGSWRGYREQTCYAILALVQARHVCFFTHMVDRLQSCVDRGFSWLKSCSFHSQDLTWTSKTAYEVGFVAEAYKLAALQSASLEVPAATIGHSVTSAVPSSDLEKYMRLVRKTALFSPLDEWGLMASIIESSFFVPLLQAQRVEIYPRDNIKVDEDKYLSIIPFTWVGCNNRSRTFASNRWLYDMMYLSLLGYQTDEYMEAVAGPVFGDVSLLHQTIDKVIDNTMGNLARANGTVHSGNGHQHESPNIGQVEDTLTRFTNSVLNHKDVLNSSSSDQDTLRREFRTFMHAHITQIEDNSRFSKQASSDAFSSPEQSYFQWVNSTGGSHVACAYSFAFSNCLMSANLLQGKDAFPSGTQKYLISSVMRHATNMCRMYNDFGSIARDNAERNVNSIHFPEFTLCNGTSQNLDERKERLLKIATYEQGYLDRALEALERQSRDDAGDRAGSKDMRKLKIVKLFCDVTDLYDQLYVIKDLSSSMK

SEQ ID NO: 21 - DNA, 1533 bp, Lactuca sativa
  CDS (1)..(1533)
atggacttgcaaaccatggccccaatgggttctgctgctatcgccatcggtggtccagctgtcgccgttgctggtggtatctccttgttgttcttgaaatccttcttgtctcaacaaccaggtaacccaaaccacttgccatctgtcccagctgtcccaggtgttcctctattaggtaacttgttggaattgaaggaaaagaagccatacaagacctttaccaaatgggctgaaacttacggtccaatctactccatcaagaccggtgctacctccatggttgtcgttaactccaaccaattggccaaggaagctatggtcaccagattcgactccatctctaccagaaagttgtccaaggctttgcaaattttgactgctgacaagaccatggttgccatgtctgactacgatgactaccataaaactgtcaagagaaacttgttgacttctattttgggtccagctgctcaaaagagacacagagcccaccgtgacgctatgggtgacaacttgtccagacaattgcacgctttagctttgaactctcctcaagaagccattaacttcagacaaatcttccaatctgaattattcactttagctttcaagcaaactttcggtagagatatcgaatctatcttcgtcggtgatttgggtactaccatgaccagagaagaaatgttccaaattttggttgttgacccaatgatgggtgctattgacgttgactggagagacttcttcccatacttgaaatggattccaaacgccaaattggaagaaaagatcgaacaaatgtacatcagaagaaaggctgttatgaaggctgttatccaagaacacagaaagagaattgattctggtgaaaacttggattcttacattgatttcttgttggctgaagctcaaccattgactgaaaagcaattattgatgtccttgtgggaaccaattattgaaacttctgacaccaccatggttaccactgaatgggctatgtacgaattgtctaagcacccaaacaagcaacaaagattatacaatgaaatcagaaacatctgtggttctgaaaagatcactgaagaaaagttgtgtaagatgccatacttatctgctgtctttcacgaaactttacgtgttcactctccagtttccatcattccattacgttacgttcacgaaaacactgaattgggtggttaccatgtcccagctggtactgaattggctgtcaacatctacggttgtaacatggaaagagaaatctgggaaaacccagaagaatggtccccagaaagattcttggctgaaaacgaaccagttaacttgcaaaagaccatggcctttggtgctggtaagagagtctgtgccggtgctatgcaagctatgttgttggcttgtgtcggtattggtagaatggttcaagaattcgaatggagattgaaagatgacgtcgaagaagatgtcaacactttaggtttgaccactcaaagattgaacccaatgttggctgttatcaagcctaggaat

SEQ ID NO: 22 - protein, 511 aa, Lactuca sativa
MDLQTMAPMGSAAIAIGGPAVAVAGGISLLFLKSFLSQQPGNPNHLPSVPAVPGVPLLGNLLELKEKKPYKTFTKWAETYGPIYSIKTGATSMVVVNSNQLAKEAMVTRFDSISTRKLSKALQILTADKTMVAMSDYDDYHKTVKRNLLTSILGPAAQKRHRAHRDAMGDNLSRQLHALALNSPQEAINFRQIFQSELFTLAFKQTFGRDIESIFVGDLGTTMTREEMFQILVVDPMMGAIDVDWRDFFPYLKWIPNAKLEEKIEQMYIRRKAVMKAVIQEHRKRIDSGENLDSYIDFLLAEAQPLTEKQLLMSLWEPIIETSDTTMVTTEWAMYELSKHPNKQQRLYNEIRNICGSEKITEEKLCKMPYLSAVFHETLRVHSPVSIIPLRYVHENTELGGYHVPAGTELAVNIYGCNMEREIWENPEEWSPERFLAENEPVNLQKTMAFGAGKRVCAGAMQAMLLACVGIGRMVQEFEWRLKDDVEEDVNTLGLTTQRLNPMLAVIKPRN

SEQ ID NO: 23 - DNA, 1536 bp, Lactuca sativa
  CDS (1)..(1536)
atggatggtgtcattgacatgcaaaccattccattgagaaccgccattgccattggtggtactgctgttgctttggttgttgctctatacttctggttcttgagatcttacgcttctccatctcaccactctaaccatttgccacctgttccagaagttccaggtgtcccagtcttgggtaacttgttgcaattgaaagaaaagaagccatacatgactttcaccaaatgggctgaaatgtacggtccaatctactctatcagaactggtgctacctccatggttgttgtttcctctaacgaaattgccaaggaagttgttgtcactagattcccatccatctccaccagaaagttgtcttacgctttgaaggtcttgactgaagataagtccatggttgctatgtctgattaccatgactaccacaagaccgtcaaaagacacattttgactgctgtcttaggtccaaacgcccaaaagaagttccgtgctcacagagacaccatgatggaaaacgtttccaatgaattgcatgccttctttgaaaagaacccaaaccaagaagtcaacttgagaaagatcttccaatctcaattgttcggtttggccatgaagcaagctttgggtaaggatgtcgaatctatctacgtcaaggacttggaaactaccatgaagagagaagaaatctttgaagtcttggttgttgacccaatgatgggtgccattgaagtcgattggagagacttcttcccatacttgaaatgggttccaaacaaatctttcgaaaacatcattcacagaatgtacacccgtcgtgaagctgtcatgaaggctttgatccaagaacacaagaagagaattgcttctggtgaaaacttaaactcctacattgactacttgttgtctgaagctcaaactttgactgacaagcaattgttgatgtccctatgggaaccaatcattgaatcttccgacaccaccatggtcaccactgaatgggctatgtacgaattggctaagaatccaaacatgcaagacagattgtacgaagaaatccaatctgtttgtggttccgaaaagatcactgaagaaaacttgtctcaattaccatacttgtacgctgttttccaagaaactttgagaaagcactgtccagttccaatcatgccattgagatacgtccacgaaaacaccgttttgggtggttaccacgttccagctggtactgaagttgctatcaacatctatggttgtaacatggacaagaaggtctgggaaaacccagaagaatggaacccagaaagattcttatccgaaaaggaatccatggacttgtacaagaccatggccttcggtggtggtaagagagtttgtgctggttctttgcaagctatggtcatctcttgtatcggtattggtagattagtccaagattttgaatggaaattgaaagatgacgctgaagaagatgtcaacactttaggtttaaccactcaaaagttgcacccattattggctttgatcaaccctcgaaag

SEQ ID NO: 24 - protein, 512 aa, Lactuca sativa
MDGVIDMQTIPLRTAIAIGGTAVALVVALYFWFLRSYASPSHHSNHLPPVPEVPGVPVLGNLLQLKEKKPYMTFTKWAEMYGPIYSIRTGATSMVVVSSNEIAKEVVVTRFPSISTRKLSYALKVLTEDKSMVAMSDYHDYHKTVKRHILTAVLGPNAQKKFRAHRDTMMENVSNELHAFFEKNPNQEVNLRKIFQSQLFGLAMKQALGKDVESIYVKDLETTMKREEIFEVLVVDPMMGAIEVDWRDFFPYLKWVPNKSFENIIHRMYTRREAVMKALIQEHKKRIASGENLNSYIDYLLSEAQTLTDKQLLMSLWEPIIESSDTTMVTTEWAMYELAKNPNMQDRLYEEIQSVCGSEKITEENLSQLPYLYAVFQETLRKHCPVPIMPLRYVHENTVLGGYHVPAGTEVAINIYGCNMDKKVWENPEEWNPERFLSEKESMDLYKTMAFGGGKRVCAGSLQAMVISCIGIGRLVQDFEWKLKDDAEEDVNTLGLTTQKLHPLLALINPRK

SEQ ID NO: 25 - DNA, 1575 bp, Sphaceloma manihoticola
  CDS (1)..(1575)
atgatggacgacaccacttctccatactccacttaccactctgtcagatccattagaaaccaatctgcttgggctttggctccaattgctgtctttatttgttacgttgtcttgagacacaacagaaagtctgtcccagctgcctccgctggttctcactccatcttggaaccattatggttagctagattacgtttcatcagagactccagattcatcatcggtcaaggttactccaagttcaaggatactatcttcaaggttaccaaggtcggtgctgacatcatcgttgttgctccaaagtacgtcgaagaaatcagaagattgtctcgtgacaccggtagatctgttgaaccattcatccacgatttcgctggtgaattgttgggtggtttgaatttcttggaatctgatttgcaaaccagagttgtccaacaaaagttgaccccaaacttgaaaactattgtcccagtcatggaagatgaaatgcattacgctttggtttctgaattggattcttgtttggacggttccgaacactggaccagagttgacatgattcacatgttgtccagaatcgtttccagaatttctgccagaatcttcttgggtccaaagtactgtagaaacgacttatggttaaagaccaccgctgaatacactgaaaacttgttcttgaccggtactctattgagatttgtcccaagaatgttgcaaaagtggatcgctccattactaccatctttccgtcaattgcaagaaaacagacaagctgccagaaagatcatttctgaaattttgactgaccatcaaccagaaaagcacgatgaaacctctgacaacggtgacccatacccagatatcttgactttgatgttccaagctgcccgtggtaaggaaaaggacatcgaagatatcgctcaacacactttgttgctatctttgtcctccattcacactaccgctttgaccatgactcaagctttgtacgacttgtgtgcctacccacaatacttggaccctgttaagcacgaaattgctgacaccttgcaatctgaaggttcctggtctaaggctatgttggacaaattgcacatgatggactctttgttgagagaatctcaaagattatctcctgttttcttattgactttcaacagaattttgcacaccccattgactttgtccaacggtatccatttgccaaagggtactagaattgctgctccttctgatgccattttgaacgatccatctttagtcccaggtccacaaccagctgacactttcgacccatttagatacatcaaccactccactggtgatgctaagaaaaccaagaccaacttccaaaccacttctttgcaaaacatggctttcggttacggtaaatacgcttgtccaggtcgtttctatgttgccaacgaaatcaaattggttttaggtcacttgttgatgcactacgaattcaagttcccaccaggtatgggtagaccagttaactccaccgtcgatactgacatgtacccagatttgggtgccagattgttggttagaaagagaaagatggaagaa

SEQ ID NO: 26 - protein, 525 aa, Sphaceloma manihoticola
MMDDTTSPYSTYHSVRSIRNQSAWALAPIAVFICYVVLRHNRKSVPAASAGSHSILEPLWLARLRFIRDSRFIIGQGYSKFKDTIFKVTKVGADIIVVAPKYVEEIRRLSRDTGRSVEPFIHDFAGELLGGLNFLESDLQTRVVQQKLTPNLKTIVPVMEDEMHYALVSELDSCLDGSEHWTRVDMIHMLSRIVSRISARIFLGPKYCRNDLWLKTTAEYTENLFLTGTLLRFVPRMLQKWIAPLLPSFRQLQENRQAARKIISEILTDHQPEKHDETSDNGDPYPDILTLMFQAARGKEKDIEDIAQHTLLLSLSSIHTTALTMTQALYDLCAYPQYLDPVKHEIADTLQSEGSWSKAMLDKLHMMDSLLRESQRLSPVFLLTFNRILHTPLTLSNGIHLPKGTRIAAPSDAILNDPSLVPGPQPADTFDPFRYINHSTGDAKKTKTNFQTTSLQNMAFGYGKYACPGRFYVANEIKLVLGHLLMHYEFKFPPGMGRPVNSTVDTDMYPDLGARLLVRKRKMEE

SEQ ID NO: 27 - DNA, 1440 bp, Artemisia annua
  CDS (1)..(1440)
atgccaatgaccgtcatgttgttgttcgttttcttattattcattgccatctgtttcttcttggtccacagacacaactccaccaccaccaagaacttgccaccaggttctttcggttggccattcatcggtgaaactttggcttacatcagatccaagagaggtggtgacccagaaagattcaccaaggaaagaattgaaaagtacggttccactttagtctttaagacctctgttgctggtgaaagaatggctgtcttttgtggtccagaaggtaacaagttcttgtttggtaacgaaaacaaattggttgcttcctggtggccaaactctgttagaattttgttcgaaaagtgtttgattaccatcagaggtgacgaagctaaatggttacgtaaaatgatgttcgcttacttgggtccagacgctctatccaacagatacactggtactatggaagttgttaccagattgcacatccaaaaccactggcaaggtaagtctgaattgaaggtctttgaaaccgttagaccatacttgttcgaattggcctgtagattattcttgtctttggatgacccaaagcacgttgctgaattgggtactttattcaacactttcttgaagggtttgactgaattgccaatcaacattccaggtactagattctacagagccaagagagctgccaacgccatcaagaaacaattgattgtcatcatcaagcaacgtcgtcaagctttgaagcaagaagatcaatcttcttctttcgaagatttgctatctcatttgttagtctcctctgatgaaaacggtagattcttgtccgaagctgaaattgccaataatgtcttgttgttgttgtttgctggtcacgacacttctgctgtttccatcactttgttgatgaagtctttggctgaacaccctcaagtctacgacaacgttttgaaggaacaattaggtatcttggaagccaaggctccaggtgaaatgttgaactgggaagatatccaaaagatgagatactcctggtacgttgtttgtgaagtcatgagattgattccacctgttgttggttctttcagagaagctttggttgatttcgaatacgctggttacactattccaaagggttggaagatcatctggtctgctgtcatgactcacaaggaagaaaacaacttcccaaacgctactaagttcgacccatccagattcgaaggtgctggtccaaccccattcacctacgttccattcggtggtggtccaagaatgtgtttgggtaaggaattggctcgtgtcagaattttggttttcttacataacatcatgaccaaattcaaatgggacttgttgattccagacgaaaagatcggttacgacccattggctaccccagtcaagggtttgccagtcagattgcaccctcaccaagtg

SEQ ID NO: 28 - protein, 480 aa, Artemisia annua
MPMTVMLLFVFLLFIAICFFLVHRHNSTTTKNLPPGSFGWPFIGETLAYIRSKRGGDPERFTKERIEKYGSTLVFKTSVAGERMAVFCGPEGNKFLFGNENKLVASWWPNSVRILFEKCLITIRGDEAKWLRKMMFAYLGPDALSNRYTGTMEVVTRLHIQNHWQGKSELKVFETVRPYLFELACRLFLSLDDPKHVAELGTLFNTFLKGLTELPINIPGTRFYRAKRAANAIKKQLIVIIKQRRQALKQEDQSSSFEDLLSHLLVSSDENGRFLSEAEIANNVLLLLFAGHDTSAVSITLLMKSLAEHPQVYDNVLKEQLGILEAKAPGEMLNWEDIQKMRYSWYVVCEVMRLIPPVVGSFREALVDFEYAGYTIPKGWKIIWSAVMTHKEENNFPNATKFDPSRFEGAGPTPFTYVPFGGGPRMCLGKELARVRILVFLHNIMTKFKWDLLIPDEKIGYDPLATPVKGLPVRLHPHQV

SEQ ID NO: 29 - DNA, 1365 bp, Ricinus communis
  CDS (1)..(1365)
atggaattggtcatgttcccagtcttggctttggtttccactttgttcttgttggctttgcacttcatcatcagaactttgaaggaaagattattcggttctccaaatttgccaccaggtagattaggttggccattgattggtgaaaccccagctttcttcagagctggtttcgaagccaagccagaaaagttcatcggtgaaagaatggaaaagtacgactctcgtgttttcaagacctctttgttgggtaagcctttcgctgtcatttctggtactgctggtcacaagttcttgttttccaacgaaaacaaattggttaacttgtggtggccagaatccgtcagaatgttgttcaagtctgctttggtttccgttgttggtgacgaagccaagagaatcagaaagatgttgatgactttcttaggtttggatgctttgaagaactacactgaaagaattgacatggtcacccaacaacacatcagaacctactgggaaggtaaggaagaagttaccgtttactccactttgaaattgtacactttcaccttggcttgtaacttgtttgcctccatcaacgaccctgaaagattatccaagttgggtgctcacttcgatgttttcgttaagggtgttatctctttgccaatttccattccaggtactagattatacaaatccatgaaggctgccaacgccattagagaagaattgaaattgattgtccgtgacagaaaggaagctttggaaagaaagatggcttctccaactcaagatttgttgtcttatttgttggtcgactctgacaccaacggtcgtttcttgtctgaaatggaaatcttggacaacatcatgttgctattgtacgctgaacaattggaaattgctaactccaagaagccaggtgaattattgcaatgggaagatgtccaaaagatgagatactcctggaacgtcatctctgaagtcttgagattgtctccaccagtttcttctgcttacagacacgccattgttgactttacctacgaaggttacaccattccaaagggttggcaattgttcacctctttcggtactacccaccgtgacccagctttattcccaaacccagaaagattcgatgcttccagatttgaaggtaacggtccaccttcttactcttacatcccattcggtggtggtccaagaatgtgtattggttacgaatttgccagattggaaatgttgatcttcttacataacatcatcaagagattcaaatgggatatcttgatcccagatgaacaattcggttacaacccattattggctccatctcaaggtttcccagtcagattaagaccacaccactctcatcta

SEQ ID NO: 30 - protein, 455 aa, Ricinus communis
MELVMFPVLALVSTLFLLALHFIIRTLKERLFGSPNLPPGRLGWPLIGETPAFFRAGFEAKPEKFIGERMEKYDSRVFKTSLLGKPFAVISGTAGHKFLFSNENKLVNLWWPESVRMLFKSALVSVVGDEAKRIRKMLMTFLGLDALKNYTERIDMVTQQHIRTYWEGKEEVTVYSTLKLYTFTLACNLFASINDPERLSKLGAHFDVFVKGVISLPISIPGTRLYKSMKAANAIREELKLIVRDRKEALERKMASPTQDLLSYLLVDSDTNGRFLSEMEILDNIMLLLYAEQLEIANSKKPGELLQWEDVQKMRYSWNVISEVLRLSPPVSSAYRHAIVDFTYEGYTIPKGWQLFTSFGTTHRDPALFPNPERFDASRFEGNGPPSYSYIPFGGGPRMCIGYEFARLEMLIFLHNIIKRFKWDILIPDEQFGYNPLLAPSQGFPVRLRPHHSHL

SEQ ID NO: 31 - DNA, 1428 bp, Stevia rebaudiana
  CDS (1)..(1428)
atgattcaagttttgaccccaatcttgttgttcttgatcttcttcgtcttttggaaggtctacaagcaccaaaagaccaagatcaacttgcctccaggttctttcggttggccattcttgggtgaaactttagctttgttgagagctggttgggactctgaaccagaaagattcgttagagaaagaatcaagaagcatggttctccattggttttcaagacctctttgttcggtgacagattcgctgtcttgtgtggtccagctggtaacaaattcttgttctgtaacgaaaacaaattggttgcttcctggtggccagttccagttagaaagttgttcggtaagtccttgttgactatcagaggtgacgaagccaagtggatgagaaagatgttattgtcttacttgggtccagatgcctttgctacccactacgctgtcaccatggacgttgttacccgtcgtcacattgatgtccactggagaggtaaggaagaagttaacgttttccaaaccgtcaaattgtacgctttcgaattggcttgtagattattcatgaacttggatgacccaaaccatattgccaaattaggttctttattcaacatcttcttgaagggtatcatcgaattgccaattgatgttccaggtactagattctactcctccaagaaggctgctgctgccatcagaattgaattgaagaaattgatcaaggccagaaagttggaattgaaggaaggtaaggcttcttcctctcaagatttgctatcccacttattgacctctccagacgaaaatggtatgttcttgactgaagaagaaattgtcgacaacatcttattgctattgttcgctggtcacgacacctctgctctatccattactttgttgatgaaaactttgggtgaacactctgatgtttacgacaaggtcttaaaggaacaattggaaatctccaagactaaggaagcttgggaatctttgaaatgggaagatatccaaaagatgaagtactcctggtctgttatctgtgaagtcatgagattgaaccctccagtcattggtacttacagagaagctttggtcgatatcgactacgctggttacaccattccaaagggttggaagttgcactggtctgccgtttccactcaaagagatgaagctaacttcgaagatgtcaccagatttgacccatctcgtttcgaaggtgctggtccaactccattcacttttgttccattcggtggtggtccaagaatgtgtttgggtaaggaattcgctagattagaagttttggctttcttgcacaacattgtcaccaactttaaatgggacttgttgattccagacgaaaagatcgaatacgacccaatggctactccagccaagggtttgccaatcagattgcaccctcaccaagtc

SEQ ID NO: 32 - protein, 476 aa, Stevia rebaudiana
MIQVLTPILLFLIFFVFWKVYKHQKTKINLPPGSFGWPFLGETLALLRAGWDSEPERFVRERIKKHGSPLVFKTSLFGDRFAVLCGPAGNKFLFCNENKLVASWWPVPVRKLFGKSLLTIRGDEAKWMRKMLLSYLGPDAFATHYAVTMDVVTRRHIDVHWRGKEEVNVFQTVKLYAFELACRLFMNLDDPNHIAKLGSLFNIFLKGIIELPIDVPGTRFYSSKKAAAAIRIELKKLIKARKLELKEGKASSSQDLLSHLLTSPDENGMFLTEEEIVDNILLLLFAGHDTSALSITLLMKTLGEHSDVYDKVLKEQLEISKTKEAWESLKWEDIQKMKYSWSVICEVMRLNPPVIGTYREALVDIDYAGYTIPKGWKLHWSAVSTQRDEANFEDVTRFDPSRFEGAGPTPFTFVPFGGGPRMCLGKEFARLEVLAFLHNIVTNFKWDLLIPDEKIEYDPMATPAKGLPIRLHPHQV

SEQ ID NO: 33 - DNA, 1575 bp, Arabidopsis thaliana
  CDS (1)..(1575)
atggaatctttagtcgttcacaccgtcaatgccatctggtgtattgtcattgttggtattttctctgttggttaccacgtttacggtcgtgccgttgttgaacaatggagaatgagaagatctttgaaattgcaaggtgtcaagggtccaccaccatccattttcaacggtaatgtctctgaaatgcaaagaatccaatctgaagctaagcactgttccggtgacaacatcatttctcacgattactcctcctctttgttccctcactttgaccactggagaaagcaatacggtagaatctacacctactccactggtttgaaacaacatttgtacatcaaccatccagaaatggtcaaggaattatctcaaaccaacactttgaacttaggtcgtatcactcacatcaccaagagattgaacccaatcttaggtaacggtatcatcacttccaacggtccacactgggctcatcaaagaagaattattgcttacgaattcacccacgacaaaatcaagggtatggtcggtttgatggtcgaatctgccatgccaatgttgaacaaatgggaagaaatggttaagagaggtggtgaaatgggttgtgacatccgtgttgacgaagatttgaaggatgtttctgctgatgtcattgctaaggcttgtttcggttcctctttctccaagggtaaggctatcttctccatgatcagagacttgttgactgccatcactaagagatctgttttgttcagattcaacggtttcaccgacatggttttcggttccaagaagcatggtgatgtcgatatcgatgctttggaaatggaattggaatcttctatctgggaaaccgttaaggaaagagaaattgaatgtaaggacactcacaagaaggatttgatgcaattaatcttggaaggtgccatgagatcttgtgacggtaacttgtgggacaagtctgcttacagaagatttgttgtcgacaactgtaaatccatctactttgccggtcacgactctactgctgtctccgtttcctggtgtttgatgttgctagctttgaacccatcctggcaagtcaagatcagagatgaaatcttatcttcttgtaagaacggtattccagatgctgaatccattccaaacttgaagaccgttaccatggtcattcaagaaactatgagattgtacccaccagctccaattgtcggtagagaagcttccaaggacatcagattaggtgacttggttgttccaaagggtgtttgtatctggactttgattccagctttgcaccgtgacccagaaatctggggtccagatgctaacgacttcaagccagaaagattctctgaaggtatttccaaggcttgtaaatacccacaatcttacatcccattcggtttgggtccaagaacctgtgtcggtaagaacttcggtatgatggaagtcaaagttttggtttctttgattgtttccaagttctctttcaccttgtctccaacttaccaacactctccatctcacaagttgttggttgaacctcaacacggtgttgtcattagagtcgtt

SEQ ID NO: 34 - protein, 525 aa, Arabidopsis thaliana
MESLVVHTVNAIWCIVIVGIFSVGYHVYGRAVVEQWRMRRSLKLQGVKGPPPSIFNGNVSEMQRIQSEAKHCSGDNIISHDYSSSLFPHFDHWRKQYGRIYTYSTGLKQHLYINHPEMVKELSQTNTLNLGRITHITKRLNPILGNGIITSNGPHWAHQRRIIAYEFTHDKIKGMVGLMVESAMPMLNKWEEMVKRGGEMGCDIRVDEDLKDVSADVIAKACFGSSFSKGKAIFSMIRDLLTAITKRSVLFRFNGFTDMVFGSKKHGDVDIDALEMELESSIWETVKEREIECKDTHKKDLMQLILEGAMRSCDGNLWDKSAYRRFVVDNCKSIYFAGHDSTAVSVSWCLMLLALNPSWQVKIRDEILSSCKNGIPDAESIPNLKTVTMVIQETMRLYPPAPIVGREASKDIRLGDLVVPKGVCIWTLIPALHRDPEIWGPDANDFKPERFSEGISKACKYPQSYIPFGLGPRTCVGKNFGMMEVKVLVSLIVSKFSFTLSPTYQHSPSHKLLVEPQHGVVIRVV

SEQ ID NO: 35 - DNA, 1437 bp, Ixeris dentata var. albiflora
  CDS (1)..(1437)
atggatgccgttgccgtcaactctgaaaccatgtcccacgttgttttcattccattcccagctcaatctcacatcaagtgtatgttgaagttggcccgtctattacaccacaagggtttacacatcactttcgtcaacactgaattgaaccacaaccaattgttatcttctggtggtccaaactctttggacggtgaaccaggtttcagattcaagaccattccagatggtgttccagaaggtgctccagacttcatgtacgctttatgtgactctgtcttgaacaaaatgttggacccatttgtcgatttgattggtagattggaatctccagccacctgtatcatcggtgacggtatgatgcctttcactgttgctgctgctgaaaagttgaaattgccaattatgcatttctggactttcccagctgctgctttcttgggttactaccaagctccaaacttgattgaaaagggtttcatcccacctaaggacgaatcctggtccaccaacggttacttggaaaccgttgttgactccatttctggtttggaaggtttcagaatcagagatatcccagcttacttcagaaccactgacccaaacgattctgatttcaactacatcatcgaatgtgttaaggccatcagaaaggtttccaacattgtcttgcacactttcgaagaattggaatctaccattatcaaggccttgcaaccaatgatcccacacgtctacaccattggtccattggaattgttgttgaacccaatcaagttagaagaagaaactgaaaagttggacattaaaggttactctttatggaaggaagatgacgaatgtttgaaatggttggactccaaggaaccaaactccgtcatttacgtcaactttggttctttgatctccatgtccaaggaacaattagctgaatttggttggggtttggttaactctaaccactgtttcttgtgggttatcagaagagacttggttgtcggtgattctgctccattgcctccagaattgaaagaacgtatcaacgaaagaggtttcatcgcttcctggtgtccacaagaaaaggtcttgaaacattcctctgttggtggtttcttgactcactgtggttggggttccatcatcgaatctctatctgctggtgtcccaatgttgtgttggccatacttgtgggaccaaccaaccaactgtcgtcaagcttgtaaggaatgggaagttggtttggaaattgaaggtaacgttaacaaggatgaagtcgaaagattgaccagagaattgatcggtggtgaaaagggtaagcaaatgagatccaaggctttggaatggaagaagaagatcgaaattgctactggtccaaagggttcttcttctttaaatgtcgaaagattggctaacgacattaacatgttctccagaaat

SEQ ID NO: 36 - protein, 479 aa, Ixeris dentata var. albiflora
MDAVAVNSETMSHVVFIPFPAQSHIKCMLKLARLLHHKGLHITFVNTELNHNQLLSSGGPNSLDGEPGFRFKTIPDGVPEGAPDFMYALCDSVLNKMLDPFVDLIGRLESPATCIIGDGMMPFTVAAAEKLKLPIMHFWTFPAAAFLGYYQAPNLIEKGFIPPKDESWSTNGYLETVVDSISGLEGFRIRDIPAYFRTTDPNDSDFNYIIECVKAIRKVSNIVLHTFEELESTIIKALQPMIPHVYTIGPLELLLNPIKLEEETEKLDIKGYSLWKEDDECLKWLDSKEPNSVIYVNFGSLISMSKEQLAEFGWGLVNSNHCFLWVIRRDLVVGDSAPLPPELKERINERGFIASWCPQEKVLKHSSVGGFLTHCGWGSIIESLSAGVPMLCWPYLWDQPTNCRQACKEWEVGLEIEGNVNKDEVERLTRELIGGEKGKQMRSKALEWKKKIEIATGPKGSSSLNVERLANDINMFSRN

SEQ ID NO: 37 - DNA, 1446 bp, Ricinus communis
  CDS (1)..(1446)
atgggttccattgtccgtgaccacgacaagccacacgttgtttgtgttccatacccagctcaaggtcacgttaacccaatggtcaaattggccaagttgttgcactacaacgatttccacgtcactttcgtcaacactgaatacaaccacagaagattattgaactccagaggtccttcttctttggacggtttgccagatttcagattcgaagccatctctgacggtttgccaccatctgatgctaacgctacccaagatatcccatctctatgtgactctacctccaagaactctttggctccattcagaaacttgttgttgaagttgaaatcctctgactctttgccaccagttacctgtatcatttctgatgcttgtatgtccttcactttggatgctgctgaagaatttggtattccagaaatcttattctggaccccatcttcttgtggtgttttgggttactctcaataccacactttgattgaaaagggtttgactccattaaaggacgcctcttacttgaccaacggttacttggaaaccactttggactggattccaggtatgaaggatatcagattcagagatttgccatctttcatcagaaccactgacagaaacgatatcatgttgaactttgttgtccgtgaattggaaagaacttccagagcttctgctgttgttttcaacactttctacgccttcgaaaaggacgtcttagatgtcttatccaccatgttcccaccaatctactccatcggtccattgcaattgttggttgaccaaatcccaattgacagaaacttgggtaacattggttccaacttatggaaggaacaaccagaatgtattgactggttggacaccaaggaaccaaactctgttgtctacgtcaacttcggttccatcactgttatcactcctcaacaaatgattgaattcgcttggggtctagcttcttctaagaaaccattcttatggatcatcagaccagacttggttatcggtgaaaacgctatgttgccagctgaattcgtttctgaaaccaaggatcgtggtatgttggcttcttggggtcctcaagaacaaattttgaaacatccagctgtcggtggtttcttgtctcacatgggttggaactccactttggactccatgtccggtggtgtcccaatggtttgttggccattctttgctgaacaacaaaccaactgtagatttgcttgtaccgaatggggtgttggtatggaaattgacaacaatgtcaagagagatgaagtcaagaagttggttgaagttttgatggacggtaagaaaggtaaggaaatgaagtccaaggccatggaatggaaaaccaaggctgaagaagctgccaagccaggtggttcctctcataacaacttggacagattagtcaagttcatcaagggtcaaaagaat

SEQ ID NO: 38 - protein, 482 aa, Ricinus communis
MGSIVRDHDKPHVVCVPYPAQGHVNPMVKLAKLLHYNDFHVTFVNTEYNHRRLLNSRGPSSLDGLPDFRFEAISDGLPPSDANATQDIPSLCDSTSKNSLAPFRNLLLKLKSSDSLPPVTCIISDACMSFTLDAAEEFGIPEILFWTPSSCGVLGYSQYHTLIEKGLTPLKDASYLTNGYLETTLDWIPGMKDIRFRDLPSFIRTTDRNDIMLNFVVRELERTSRASAVVFNTFYAFEKDVLDVLSTMFPPIYSIGPLQLLVDQIPIDRNLGNIGSNLWKEQPECIDWLDTKEPNSVVYVNFGSITVITPQQMIEFAWGLASSKKPFLWIIRPDLVIGENAMLPAEFVSETKDRGMLASWGPQEQILKHPAVGGFLSHMGWNSTLDSMSGGVPMVCWPFFAEQQTNCRFACTEWGVGMEIDNNVKRDEVKKLVEVLMDGKKGKEMKSKAMEWKTKAEEAAKPGGSSHNNLDRLVKFIKGQKN

SEQ ID NO: 39 - DNA, 1374 bp, Ixeris dentata var. albiflora
  CDS (1)..(1374)
atggctgaagaacacaacaagaccaacaactcttctcctcacgttgtcatcttcccattcccatctcaaggtcacattaacccattgattcaatttgccaagagattgtcctccaagggtgtcaagccaactttgatcactaccatctacattgctaagacctctccatacccaaactcttccattgttgttgaaccaatttctgatggtttcgacgacggtggtttcaagtctgccacttctgctgaatcttacattgacactttccaccaagttggttccaaatctctagctaacttgatcagaaagttggtcaacgaaggtaaccatgtcgatgctatcatctacgactctttcgtcacctgggctttggatgttgctatggaatacggtattgacggtggttgtttcttcacccaagcttgtgctgtcaacaacatctactaccatgtttacaagggtgtcttggaaattccattgcaagctgctgctccaccaaccgtcactatcttattgcctgaattgcctcaattacaattatgggaaactccatcctttgtccacaacccaggtccatacccaggttgggctcacattgttttcaaccaattcccaaacatccacaacgccagatgggttttctccaacactttcttcaaattggaagaacaagttatcaaatggatgagattgatgtggccattgatggttgtcggtccaactgttccatccatgtacttggacaagagattagaagatgacgatgactacggtatgtctttgttgaagccaaaccacattgaatgtatgggttggttgaataacaaaccaaagggttccgttgtctacgtttccttcggttcctacggtgaattaggtgttgctcaaatggaagaaattgcttggggtttgaacgaatcttccgtcaactatttatgggttgtcagagaaactgaaaaggaaaagttgccaaagtctttcttggctaatggtttgattgttgaatggtgtcgtcaattggaagttttggctcacgaagctgtcggttgtttcgtcactcactgtggtttcaactcctctttggaaaccatctctttgggtgtcccagttgttgccatcccacaatggaccgatcaaaccaccaacgctaagtgtttggaagatatctggggtgttggtatcagagccaagactccagtcaccagaaccaacttggtctggtgtatcaaggaaatcatggaaggtgaacgtggtgctgttgctagaaagaacgccatcaagtggaaggacttggccattgaagctgtctctccaggtggttcctctgacaaggacatcaacgaatttgtttctcaattgtctccaatcaaatgt

SEQ ID NO: 40 - protein, 458 aa, Ixeris dentata var. albiflora
MAEEHNKTNNSSPHVVIFPFPSQGHINPLIQFAKRLSSKGVKPTLITTIYIAKTSPYPNSSIVVEPISDGFDDGGFKSATSAESYIDTFHQVGSKSLANLIRKLVNEGNHVDAIIYDSFVTWALDVAMEYGIDGGCFFTQACAVNNIYYHVYKGVLEIPLQAAAPPTVTILLPELPQLQLWETPSFVHNPGPYPGWAHIVFNQFPNIHNARWVFSNTFFKLEEQVIKWMRLMWPLMVVGPTVPSMYLDKRLEDDDDYGMSLLKPNHIECMGWLNNKPKGSVVYVSFGSYGELGVAQMEEIAWGLNESSVNYLWVVRETEKEKLPKSFLANGLIVEWCRQLEVLAHEAVGCFVTHCGFNSSLETISLGVPVVAIPQWTDQTTNAKCLEDIWGVGIRAKTPVTRTNLVWCIKEIMEGERGAVARKNAIKWKDLAIEAVSPGGSSDKDINEFVSQLSPIKC

SEQ ID NO: 41 - DNA, 1362 bp, Populus trichocarpa
  CDS (1)..(1362)
atggacaacaagaagtctcatgtcattgtcttgacctacccagctcaaggtcacatcaacccattgttgcaattcgccaagagattagcttccaagggtttgaaggccactttggctaccacctactacactgttaactccattgacgctccaactgtcggtgttgaaccaatctctgatggtttcgatgaaggtggtttcaagcaagcttcctctctagatgtctacttggaatctttcaagaccgtcggttccagaaccttgactgaattagtctttaaattcaaggcttctggttctcctgttaactgtgttgtttacgactccatgttgccatgggctttggacgttgccagagatttgggtatctacgctgctgccttcatgaccacctctgcttccgtctgttccatgtactggagaattgacttaggtttattgtctttgccattgaagcaacaaaccgctaccgtttctttgccaggtttgccaccattgggttgttgtgatttgccatctttcttagctgaaccaacttctcaaactgcttacttggaagttatcatggaaaagttccactccttgaacgaagatgactgggttttctgtaactctttcgaagatttggaaattgaattggtcaaggctatgagaggtaaatggccattggttatggttggtccaatggttccatctgcctacttggaccaacaaattgatggtgaccgtgcctacggtgcttctttgtggaaaccaacttcttctcaatgtttcacctggttggacactaagcctccaagatctgtcatctacgtttcctttggttccatgggtaacatctccgctgaacaagttgaagaaattgcttggggtttgaaggcttccaacagaccattcttatgggttatgaaggaatctgaaaagaaattgccaactggtttcttgaactctgtcggtgaaaccggtatggttgtttcctggtgtaaccaattggaagtcttggctcaccaagctatcggttgtttcgtcacccactgtggttggaactccactttggaaggtttgggtttaggtgttccaatggtttgtgttactgaaagatctgaccaaccaatgaacgctaagttcgttgaagatgtctggaaggtcggtgtcagagctaagaaggacgaagttggtattgtcactagagaagaattggaaaagtgtatcagaggtgtcatggacggtgaaaacggtgaagaaatcaagagaaacgccaacaaatggagagaattagctcgttctgccgtttccgtcggtggttcttctgacatgaacatcaatgaatttgttgtcaaattgttggaaggtaagaagggg

SEQ ID NO: 42 - protein, 454 aa, Populus trichocarpa
MDNKKSHVIVLTYPAQGHINPLLQFAKRLASKGLKATLATTYYTVNSIDAPTVGVEPISDGFDEGGFKQASSLDVYLESFKTVGSRTLTELVFKFKASGSPVNCVVYDSMLPWALDVARDLGIYAAAFMTTSASVCSMYWRIDLGLLSLPLKQQTATVSLPGLPPLGCCDLPSFLAEPTSQTAYLEVIMEKFHSLNEDDWVFCNSFEDLEIELVKAMRGKWPLVMVGPMVPSAYLDQQIDGDRAYGASLWKPTSSQCFTWLDTKPPRSVIYVSFGSMGNISAEQVEEIAWGLKASNRPFLWVMKESEKKLPTGFLNSVGETGMVVSWCNQLEVLAHQAIGCFVTHCGWNSTLEGLGLGVPMVCVTERSDQPMNAKFVEDVWKVGVRAKKDEVGIVTREELEKCIRGVMDGENGEEIKRNANKWRELARSAVSVGGSSDMNINEFVVKLLEGKKG

SEQ ID NO: 43 - DNA, 1377 bp, Nicotiana tabacum
  CDS (1)..(1377)
atgaccactcaaaaggctcactgtttgatcttaccatacccagctcaaggtcacatcaacccaatgttgcaattttccaagagattacaatctaagggtgtcaagatcaccattgctgctaccaagtctttcttaaagaccatgcaagaattgtccacttctgtctctgttgaagctatctctgatggttacgatgacggtggtagagaacaagctggtactttcgttgcttacatcaccagattcaaggaagttggttctgacactctatcccaattaatcggtaagttgaccaactgtggttgtccagtttcttgtatcgtctacgatcctttcttgccatgggctgtcgaagtcggtaacaactttggtgttgccactgctgctttcttcactcaatcttgtgctgttgacaacatctactaccatgtccacaaaggtgttttgaaattgccaccaactgatgttgacaaggaaatttccattccaggtttgttgaccattgaagcttctgatgttccatctttcgtttccaacccagaatcttccagaatcttggaaatgttggtcaaccaattctccaatttggaaaacactgactgggttttgatcaactctttctacgaattggaaaaggaagtcattgactggatggccaagatctacccaatcaagaccattggtccaaccattccatccatgtacttggacaaaagattaccagatgacaaggaatacggtttgtccgtctttaaaccaatgaccaatgcttgtttgaactggttgaaccaccaaccagtttcttccgttgtctacgtttctttcggttctttggctaagttggaagctgaacaaatggaagaattggcttggggtttgtccaactccaacaagaacttcttatgggttgtcagatctactgaagaatccaaattgccaaacaacttcttggaagaattggcttctgaaaagggtttggttgtttcctggtgtccacaattacaagttttggaacacaagtccatcggttgtttcttgactcactgtggttggaactctactttggaagccatctctttgggtgttccaatgattgccatgcctcactggtctgaccaaccaaccaacgccaagttggtcgaagatgtctgggaaatgggtatcagaccaaagcaagatgaaaagggtttagtccgtcgtgaagtcattgaagaatgtatcaagattgtcatggaagaaaagaagggtaagaagatcagagaaaacgccaagaaatggaaggaattggccagaaaggctgttgacgaaggtggttcttctgacagaaacattgaagaattcgtttccaaattggtcaccattgcttctgtcgagagt

SEQ ID NO: 44 - protein, 459 aa, Nicotiana tabacum
MTTQKAHCLILPYPAQGHINPMLQFSKRLQSKGVKITIAATKSFLKTMQELSTSVSVEAISDGYDDGGREQAGTFVAYITRFKEVGSDTLSQLIGKLTNCGCPVSCIVYDPFLPWAVEVGNNFGVATAAFFTQSCAVDNIYYHVHKGVLKLPPTDVDKEISIPGLLTIEASDVPSFVSNPESSRILEMLVNQFSNLENTDWVLINSFYELEKEVIDWMAKIYPIKTIGPTIPSMYLDKRLPDDKEYGLSVFKPMTNACLNWLNHQPVSSVVYVSFGSLAKLEAEQMEELAWGLSNSNKNFLWVVRSTEESKLPNNFLEELASEKGLVVSWCPQLQVLEHKSIGCFLTHCGWNSTLEAISLGVPMIAMPHWSDQPTNAKLVEDVWEMGIRPKQDEKGLVRREVIEECIKIVMEEKKGKKIRENAKKWKELARKAVDEGGSSDRNIEEFVSKLVTIASVES

SEQ ID NO: 45 - DNA, 1434 bp, Vaccaria hispanica
  CDS (1)..(1434)
atgtccaacaatgaaaacaatgccactcaagttatcgttttgccataccacggtcaaggtcacatgaacaccatggttcaatttgccaagagattagcttggaagggtgtccacgtcaccattgctaccactttcaacactatccaacaaatgaaattgaacatttcttcttacaactccatcactttggaaccaatctacgatgacactgatgactccactttgcacatcaaggacagaatggccagatttgaagctgaagccgcttccaatttgaccagagttttggaagccaagaaacaacaacaagctttaaacaagaagtgtttgttggtttaccacggttctttgaactgggctttagtcgttgctcaccaacaaaacgttgctggtgctgctttcttcaccgctgcttctgcttctttcgcttgttactactacttgcatttggaatctcaaggtaagggtgtcgacttggaagaattaccatccatcttaccaccaccaaaggtcattgttcaaaagttgccaaagtctttcttagcttacggtgacaacaactctcacaacaacaacaacaacaacaacaacaacaacaacaacaacaacatgggtttgcacccattggtcttgtggttgttgaaagattacggtaactccgtcaaggctgacttcgttttgttgaactctttcgacaaattggaagaagaagctatcaaatggatctctaacatctgttccgtcaagactatcggtccaaccattccatctacctacttggacaagcaaattgaaaacgatgttgactacggtttcaaccaatacaagccaaccaatgaagattgtatgaaatggttggacaccaaggaagccaactccgttgtctacatcgccttcggttctgttgctcgtttgtctgtcgaacaaatggctgaaattgctaaggctttggaccattcttccaagtctttcatctgggttgtcagagaaactgaaaaggaaaagttgccagtcgatttggttgaaaagatctctggtcaaggtatggttgtcccatgggctcctcaattggaagttttggctcacgatgctgtcggttgtttcgtttctcactgtggttggaactccaccattgaagctttgtctttcggtgttccaattttggccatgcctcaattcttagatcaattggtcgatgctcatttcgttgacagagtctggggtgtcggtattgctccaactgtcgatgaaaacgatttggttactcaagaagaaatctccagatgtctagacgaaatgatgggtggtggtccagaaggtgaaaagatcaagaagaacgttgccatgtggaaggaattgaccaaggaagctttggacaagggtggttcctctgacaagcacattgacgaaatcattgaatggttatcttcctcc

SEQ ID NO: 46 - protein, 478 aa, Vaccaria hispanica
MSNNENNATQVIVLPYHGQGHMNTMVQFAKRLAWKGVHVTIATTFNTIQQMKLNISSYNSITLEPIYDDTDDSTLHIKDRMARFEAEAASNLTRVLEAKKQQQALNKKCLLVYHGSLNWALVVAHQQNVAGAAFFTAASASFACYYYLHLESQGKGVDLEELPSILPPPKVIVQKLPKSFLAYGDNNSHNNNNNNNNNNNNNNMGLHPLVLWLLKDYGNSVKADFVLLNSFDKLEEEAIKWISNICSVKTIGPTIPSTYLDKQIENDVDYGFNQYKPTNEDCMKWLDTKEANSVVYIAFGSVARLSVEQMAEIAKALDHSSKSFIWVVRETEKEKLPVDLVEKISGQGMVVPWAPQLEVLAHDAVGCFVSHCGWNSTIEALSFGVPILAMPQFLDQLVDAHFVDRVWGVGIAPTVDENDLVTQEEISRCLDEMMGGGPEGEKIKKNVAMWKELTKEALDKGGSSDKHIDEIIEWLSSS

SEQ ID NO: 47 - DNA, 1443 bp, Streptococcus mutans
  CDS (1)..(1443)
atgccaatcatcaacaagaccatgttgatcacttacgctgactctctaggtaagaacttgaaagaattgaatgaaaacattgaaaactacttcggtgatgctgtcggtggtgttcacttgttgcctttcttcccatccaccggtgacagaggtttcgctccaattgactaccatgaagtcgactccgccttcggtgactgggatgacgttaagtgtttgggtgaaaagtactacttgatgtttgacttcatgatcaaccacatctccagacaatctaagtactacaaggactaccaagaaaagcacgaagcttctgcttacaaggatttgttcttgaactgggacaaattctggccaaagaacagaccaactcaagaagatgtcgacttgatctacaagagaaaggaccgtgccccaaagcaagaaatccaatttgccgatggttctgttgaacacttatggaacactttcggtgaagaacaaatcgatttggatgtcaccaaggaagttaccatggacttcatcagatccaccattgaaaacttggctgctaacggttgtgacttgatcagattggatgctttcgcttacgctgttaagaagctagacaccaacgatttcttcgtcgaaccagaaatctggactttgttggacaaggtccgtgacattgctgctgtttctggtgctgaaattttgccagaaattcacgaacattacactatccaattcaagattgctgaccacgactactacgtttacgactttgctttgccaatggttactttatactctttgtactcctccaaggtcgacagattagctaaatggttgaaaatgtctccaatgaagcaattcaccactttggacacccacgacggtattggtgttgtcgatgtcaaggatatcttgaccgatgaagaaatcacttacacttccaatgaattatacaaggtcggtgccaacgttaacagaaaatactctactgctgaatacaacaacttggatatctaccaaatcaactctacctactactctgctttgggtgacgatgaccaaaagtatttcttggccagattaatccaagctttcgctccaggtatcccacaagtctactacgttggtttcttggccggtaagaacgatttggaattgttggaatccaccaaggaaggtagaaacatcaacagacactactactcttctgaagaaattgctaaggaagtcaaaagaccagttgttaaggctttgttgaacttattcacttacagaaaccaatctgctgcctttgacttggatggtagaattgaagttgaaaccccaaacgaagctaccattgttattgaaagacaaaacaaagatggttcccacattgccaaggctgaaatcaacttgcaagacatgacttaccgtgtcactgaaaacgaccaaaccatttctttcgaa

SEQ ID NO: 48 - protein, 481 aa, Streptococcus mutans
MPIINKTMLITYADSLGKNLKELNENIENYFGDAVGGVHLLPFFPSTGDRGFAPIDYHEVDSAFGDWDDVKCLGEKYYLMFDFMINHISRQSKYYKDYQEKHEASAYKDLFLNWDKFWPKNRPTQEDVDLIYKRKDRAPKQEIQFADGSVEHLWNTFGEEQIDLDVTKEVTMDFIRSTIENLAANGCDLIRLDAFAYAVKKLDTNDFFVEPEIWTLLDKVRDIAAVSGAEILPEIHEHYTIQFKIADHDYYVYDFALPMVTLYSLYSSKVDRLAKWLKMSPMKQFTTLDTHDGIGVVDVKDILTDEEITYTSNELYKVGANVNRKYSTAEYNNLDIYQINSTYYSALGDDDQKYFLARLIQAFAPGIPQVYYVGFLAGKNDLELLESTKEGRNINRHYYSSEEIAKEVKRPVVKALLNLFTYRNQSAAFDLDGRIEVETPNEATIVIERQNKDGSHIAKAEINLQDMTYRVTENDQTISFE

SEQ ID NO: 49 - DNA, 1392 bp, Lobelia erinus
  CDS (1)..(1392)
atggacaacaaccatttgggtgaaactttgttgccattggctccaaagaacggtagaagagtcttgttcttcccatacccattacaaggtcacatttctccaatgttgaacttggccaacttgttgcactccaagggtttcaccatcaccatcatccacaccaatttgaactctccaaaccaatctgactacccacacttcactttcagaccatttgatgacggtttcccaccatactccaagggttggcaattggctaccttgtgttccagatgtgttgaaccattcagagaatgtttggctcaaatcttcttgtctgaccacactgctccagaaggtgaaagagaatctattgcttgtttgattgctgatggtttatggaacttcttgggtgctgctgtctacaactttaaattgccaatgattgttttgagaactggtaacatgtctaacattgttgccaacgttaagttgccatgtttcatcgaaaagggttacttcgaccataccaaggaaggttccaagttggaagctgctgtcccagaattcccaaccatcaagttcaaagatatcttgaaaacctacggttctaacccaaaggccatctgtgaaactttgactgctttgttgaaggaaatgagagcttcttctggtgtcatctggaactcttgtaaggaattagaacaatctgaattacaaatgatctgtaaggaattcccagttcctcatttcttgattggtcctttgcacaaatacttcccagcttcttcttcttccttggttgcccacgacccatcttccatttcctggttgaactccaaggctccaaactctgttttgtacgtttctttcggttccatctcttccatggacgaagctgaatttctagaaactgcttggggtttggccaactccatgcaacaattcttatgggttgtcagaccaggttctgtcagaggttctcaatggttggaatctttaccagatggtttcattgacaagttggatggtagaggtcacattgtcaaatgggctcctcaacaagaagtcttagctcaccaagctaccggtggtttctggactcactgtggttggaactccactttagaatccatgtgtgaaggtgtcccaatgatttgttcccacggtatcatggaccaaccaatcaatgctcgttacgttaccgatgtctggaaggttggtattgaattggaaaagggttttgactctgaagaaatcaagatggccatccgtcgtttgatggttgacaaggaaggtcaagaaatcagagaaagatcttccagattgaaggaatctttgtccaactgtttgaagcaaggtggttcttcccacgattctgtcgaatctttggttgaccacatcctatccttc

SEQ ID NO: 50 - protein, 464 aa, Lobelia erinus
MDNNHLGETLLPLAPKNGRRVLFFPYPLQGHISPMLNLANLLHSKGFTITIIHTNLNSPNQSDYPHFTFRPFDDGFPPYSKGWQLATLCSRCVEPFRECLAQIFLSDHTAPEGERESIACLIADGLWNFLGAAVYNFKLPMIVLRTGNMSNIVANVKLPCFIEKGYFDHTKEGSKLEAAVPEFPTIKFKDILKTYGSNPKAICETLTALLKEMRASSGVIWNSCKELEQSELQMICKEFPVPHFLIGPLHKYFPASSSSLVAHDPSSISWLNSKAPNSVLYVSFGSISSMDEAEFLETAWGLANSMQQFLWVVRPGSVRGSQWLESLPDGFIDKLDGRGHIVKWAPQQEVLAHQATGGFWTHCGWNSTLESMCEGVPMICSHGIMDQPINARYVTDVWKVGIELEKGFDSEEIKMAIRRLMVDKEGQEIRERSSRLKESLSNCLKQGGSSHDSVESLVDHILSF

SEQ ID NO: 51 - DNA, 1380 bp, Arabidopsis thaliana
  CDS (1)..(1380)
atggaagaaagaaagggtagaagaatcatcatgttcccattaccattcccaggtcacttcaacccaatgattgaattggctggtatctttcatcaccgtggtttctccgttaccatcttgcacacttcttacaacttcccagacccatccagacacccacacttcactttcagaaccatttctcacaacaaggaaggtgaagaagatccattatctcaatctgaaacctcttccatggacttgattgtcttggtcagaagattaaagcaacgttacgctgaaccattcagaaagtccgttgctgctgaagtcggtggtggtgaaaccgtttgttgtttggtttctgatgctatctggggtaagaacactgaagttgttgctgaagaaatcggtgtcagaagagttgttttgagaactggtggtgcctcttctttctgtgcctttgctgctttcccattattgagagacaagggttacttgccaatccaagattctcgtttggatgaacctgttactgaattgcctccattgaaggtcaaggacttaccagtcatggaaaccaatgaaccagaagaattgtacagagttgttaacgacatggttgaaggtgctaaatcttcttctggtgtcatctggaacactttcgaagatttggaaagattgtctttgatgaactgttcctccaaattgcaagttccattcttcccaatcggtccattccacaagtactctgaagatccaactccaaagactgaaaacaaggaagataccgactggttggacaagcaagaccctcaatccgttgtctacgcctcctttggttctttggccgctattgaagaaaaggaattcttggaaattgcttggggtctaagaaactctgaaagaccattcttatgggttgttagaccaggttccgtccgtggtactgaatggttggaatctctaccattgggtttcatggaaaacatcggtgacaagggtaagattgtcaaatgggctaaccaattggaagttttggctcacccagccattggtgctttctggacccactgtggttggaactccactttggaatccatctgtgaaggtgtcccaatgatctgtacctcctgttttaccgaccaacatgtcaacgccagatacattgtcgacgtctggagagtcggtatgttgttggaaagatccaagatggaaaagaaggaaatcgaaaaggttttgagatctgttatgatggaaaagggtgatggtttgagagaaagatctttgaaattgaaggaaagagctgatttctgtttgtccaaggacggttcttcttccaagtacttggacaaattggtttcccacgtcttatctttcgactcttacgctttcgcttct

SEQ ID NO: 52 - protein, 460 aa, Arabidopsis thaliana
MEERKGRRIIMFPLPFPGHFNPMIELAGIFHHRGFSVTILHTSYNFPDPSRHPHFTFRTISHNKEGEEDPLSQSETSSMDLIVLVRRLKQRYAEPFRKSVAAEVGGGETVCCLVSDAIWGKNTEVVAEEIGVRRVVLRTGGASSFCAFAAFPLLRDKGYLPIQDSRLDEPVTELPPLKVKDLPVMETNEPEELYRVVNDMVEGAKSSSGVIWNTFEDLERLSLMNCSSKLQVPFFPIGPFHKYSEDPTPKTENKEDTDWLDKQDPQSVVYASFGSLAAIEEKEFLEIAWGLRNSERPFLWVVRPGSVRGTEWLESLPLGFMENIGDKGKIVKWANQLEVLAHPAIGAFWTHCGWNSTLESICEGVPMICTSCFTDQHVNARYIVDVWRVGMLLERSKMEKKEIEKVLRSVMMEKGDGLRERSLKLKERADFCLSKDGSSSKYLDKLVSHVLSFDSYAFAS

SEQ ID NO: 53 - DNA, 2139 bp, Gibberella fujikuroi
  CDS (1)..(2139)
atggctgaattggacactttggatatcgtcgttttgggtgttatcttcttgggtactgttgcttacttcaccaagggtaagttgtggggtgtcaccaaggatccatacgctaacggttttgccgctggtggtgcttccaagccaggtagaaccagaaacattgttgaagccatggaagaatctggtaagaactgtgttgttttctacggttctcaaaccggtactgctgaagattacgcttccagattagctaaggaaggtaagtccagattcggtttgaacaccatgattgctgacttagaagattacgacttcgacaacttggataccgttccatctgacaacattgtcatgttcgttttggctacctacggtgaaggtgaacctaccgacaatgctgttgacttctacgaattcatcactggtgaagatgcttctttcaacgaaggtaacgaccctccattgggtaacttgaattatgtcgctttcggtttaggtaacaacacctacgaacactacaactccatggttagaaatgtcaacaaagctttggaaaagctaggtgcccacagaattggtgaagctggtgaaggtgacgacggtgctggtactatggaagaagatttcttggcttggaaggacccaatgtgggaagctttggctaagaagatgggtttggaagaaagagaagctgtttacgaaccaatctttgctatcaacgaaagagatgacttgactccagaagctaacgaagtttacttgggtgaaccaaataaattgcacttggaaggtactgctaagggtcctttcaactctcacaacccatacattgctccaattgctgaatcttacgaattgttctctgccaaggacagaaactgtttgcacatggaaattgatatctctggttccaacttgaaatacgaaactggtgaccacattgccatctggccaaccaacccaggtgaagaagtcaacaaattcttggatatcttggacttatccggtaagcaacactctgttgttaccgttaaggccttggaaccaactgccaaggtcccattcccaaacccaaccacttacgatgctatcctaagataccacttggaaatctgtgccccagtttcccgtcaatttgtctctactttggctgcctttgctccaaacgacgacatcaaggctgaaatgaacagattgggttctgacaaggactacttccatgaaaagactggtccacactactacaacattgccagattcttagcttccgtttctaagggtgaaaagtggaccaagattccattttccgctttcatcgaaggtttgaccaaattacaaccaagatactactccatctcctcttcttctttggtccaaccaaagaagatctccatcactgccgtcgttgaatctcaacaaattccaggtagagatgacccattcagaggtgtcgccaccaactacttgttcgctttgaagcaaaagcaaaacggtgacccaaacccagctccattcggtcaatcttacgaattgaccggtccaagaaacaaatacgatggtattcatgttccagtccacgtcagacactccaactttaaattgccttctgacccaggtaagccaatcatcatgatcggtccaggtactggtgttgctccattcagaggtttcgttcaagaaagagccaagcaagctagagatggtgtcgaagtcggtaagactttgttattcttcggttgtcgtaaatctactgaagatttcatgtaccaaaaggaatggcaagaatacaaagaagctttgggtgacaagttcgaaatgatcactgctttctccagagaaggttccaagaaggtttacgtccaacatcgtttgaaggaaagatccaaggaagtttccgacttgttgtctcaaaaggcctacttctacgtttgtggtgacgctgctcacatggctcgtgaagtcaacaccgtcttggctcaaatcattgctgaaggtagaggtgtctctgaagctaagggtgaagaaattgtcaagaacatgagatctgccaaccaataccaagtttgttctgatttcgttactttacactgtaaggaaaccacctacgctaactctgaattgcaagaagatgtctggtct

SEQ ID NO: 54 - protein, 713 aa, Gibberella fujikuroi
MAELDTLDIVVLGVIFLGTVAYFTKGKLWGVTKDPYANGFAAGGASKPGRTRNIVEAMEESGKNCVVFYGSQTGTAEDYASRLAKEGKSRFGLNTMIADLEDYDFDNLDTVPSDNIVMFVLATYGEGEPTDNAVDFYEFITGEDASFNEGNDPPLGNLNYVAFGLGNNTYEHYNSMVRNVNKALEKLGAHRIGEAGEGDDGAGTMEEDFLAWKDPMWEALAKKMGLEEREAVYEPIFAINERDDLTPEANEVYLGEPNKLHLEGTAKGPFNSHNPYIAPIAESYELFSAKDRNCLHMEIDISGSNLKYETGDHIAIWPTNPGEEVNKFLDILDLSGKQHSVVTVKALEPTAKVPFPNPTTYDAILRYHLEICAPVSRQFVSTLAAFAPNDDIKAEMNRLGSDKDYFHEKTGPHYYNIARFLASVSKGEKWTKIPFSAFIEGLTKLQPRYYSISSSSLVQPKKISITAVVESQQIPGRDDPFRGVATNYLFALKQKQNGDPNPAPFGQSYELTGPRNKYDGIHVPVHVRHSNFKLPSDPGKPIIMIGPGTGVAPFRGFVQERAKQARDGVEVGKTLLFFGCRKSTEDFMYQKEWQEYKEALGDKFEMITAFSREGSKKVYVQHRLKERSKEVSDLLSQKAYFYVCGDAAHMAREVNTVLAQIIAEGRGVSEAKGEEIVKNMRSANQYQVCSDFVTLHCKETTYANSELQEDVWS

SEQ ID NO: 55 - DNA, 2076 bp, Arabidopsis thaliana
  CDS (1)..(2076)
atgacctctgctttatacgcctccgatttgttcaagcaattgaagtccatcatgggtactgactctttgtccgatgatgttgtcttagtcattgccaccacttctttggctttggttgctggtttcgttgtcttgttgtggaagaaaaccaccgctgacagatccggtgaattgaaacctttgatgattccaaagtctttgatggccaaggacgaagatgacgacttggacttgggttctggtaagaccagagtctccattttcttcggtactcaaaccggtactgctgaaggtttcgctaaggctttgtctgaagaaattaaagccagatacgaaaaggctgccgttaaggttatcgatttggatgactacgctgctgacgatgaccaatacgaagaaaagttgaagaaggaaactttggctttcttctgtgttgctacctacggtgacggtgaaccaactgacaatgctgctagattctacaagtggttcaccgaagaaaacgaaagagacatcaaattgcaacaattggcttacggtgtctttgctttgggtaacagacaatacgaacatttcaacaagatcggtattgtcttggacgaagaattatgtaagaagggtgccaagagattgattgaagtcggtttgggtgacgatgaccaatctattgaagatgacttcaacgcttggaaggaatctttgtggtctgaattagacaagttattgaaggacgaagatgacaagtccgttgctactccatacactgctgtcatcccagaataccgtgtcgtcacccacgacccaagattcaccacccaaaagtccatggaatccaacgttgccaacggtaacaccactattgacatccaccacccatgtcgtgttgatgttgctgttcaaaaggaattgcacacccacgaatctgaccgttcttgtattcacttggaattcgatatctccagaaccggtatcacttacgaaactggtgaccacgtcggtgtctacgctgaaaaccacgttgaaatcgtcgaagaagccggtaaattgttgggtcactctttggacttggttttctccatccacgctgacaaggaagatggttctccattagaatccgccgtcccacctccattcccaggtccatgtaccttaggtactggtctagctcgttacgctgatttgttgaacccaccaagaaagtctgctttggttgctttggctgcttacgctactgaaccttctgaagctgaaaagttgaagcatttgacttctccagacggtaaggatgaatactcccaatggatcgttgcttctcaaagatctctattggaagttatggctgctttcccatctgccaagccaccattgggtgttttctttgctgccattgctccaagattgcaaccaagatactactccatttcttcttctccaagattggctccatctagagtccacgtcacctctgctttggtttacggtccaactccaaccggtagaatccacaaaggtgtttgttccacctggatgaagaacgctgttccagctgaaaagtcccacgaatgttccggtgctccaatctttatcagagcttctaacttcaagttgccatccaacccatctactccaatcgtcatggttggtccaggtactggtttggctccattcagaggtttcttacaagaaagaatggctttgaaagaagatggtgaagaattgggttcttctctattgttcttcggttgtagaaacagacaaatggacttcatctacgaagatgaattaaacaactttgtcgaccaaggtgttatctccgaattgatcatggccttctctagagaaggtgctcaaaaggaatacgttcaacataaaatgatggaaaaggctgctcaagtttgggacttgatcaaggaagaaggttacttgtacgtttgtggtgatgccaaaggtatggccagagatgtccacagaactttgcacaccattgtccaagaacaagaaggtgtttcctcttccgaagctgaagccattgtcaagaagttacaaactgaaggtcgttatttgagagatgtctgg

SEQ ID NO: 56 - protein, 692 aa, Arabidopsis thaliana [sequence omitted]

SEQ ID NO: 57 - DNA, 2133 bp, Arabidopsis thaliana
  CDS (1)..(2133)
atgtcctcttcttcttcttcttctacttccatgattgatttgatggctgccatcatcaagggtgaaccagtcattgtctctgacccagccaacgcttctgcttacgaatccgttgctgctgaattgtcctccatgttgattgaaaacagacaattcgctatgattgtcactacttccattgctgtcttgattggttgtatcgtcatgttggtctggagaagatccggttccggtaactccaagagagttgaaccattgaagccattagtcatcaagccaagagaagaagaaattgatgacggtagaaagaaggtcaccatcttctttggtactcaaaccggtactgctgaaggttttgctaaggctttgggtgaagaagccaaagctagatacgaaaagaccagattcaagatcgttgacttggacgactacgctgctgatgacgacgaatacgaagaaaagttgaagaaggaagatgttgccttcttcttcttggctacttacggtgatggtgaaccaactgacaatgctgccagattctacaaatggttcaccgaaggtaacgacagaggtgaatggttaaagaacttgaaatacggtgttttcggtctaggtaacagacaatacgaacacttcaacaaggttgccaaggttgtcgatgacatcttggttgaacaaggtgctcaaagattagtccaagtcggtttgggtgatgatgaccaatgtatcgaagatgacttcactgcttggagagaagctttgtggccagaattggacaccatcttaagagaagaaggtgataccgctgttgccaccccatacactgctgctgttttggaatacagagtttctatccacgactctgaagatgccaagttcaacgacatcaacatggctaacggtaacggttacactgttttcgacgctcaacacccatacaaggccaatgttgctgtcaagagagaattgcacactccagaatctgatcgttcttgtatccacttggaatttgacattgctggttctggtttgacctacgaaaccggtgaccacgtcggtgtcttatgtgacaacttgtctgaaactgtcgatgaagctttgagattattggacatgtctccagacacttatttctccttgcatgctgaaaaggaagatggtactccaatttcttcttccttgcctcctccattcccaccatgtaacttgagaaccgctttaaccagatacgcttgtttgctatcctctccaaagaagtccgctttggttgctttggctgctcacgcttctgacccaactgaagctgaaagattgaaacatttggcttccccagctggtaaggatgaatactccaaatgggttgttgaatctcaaagatctttgttggaagtcatggctgaattcccatctgccaagccaccattgggtgttttcttcgccggtgttgctccaagattgcaaccaagattttactccatctcttcttctccaaagattgctgaaaccagaattcacgttacctgtgccttggtctacgaaaagatgccaaccggtagaattcacaagggtgtttgttccacctggatgaagaacgctgttccatacgaaaagtctgaaaactgttcttctgctccaatcttcgtccgtcaatccaacttcaagttgccatctgactccaaggtcccaatcatcatgatcggtccaggtactggtttagctccattcagaggtttcttgcaagaaagattggccttagttgaatctggtgtcgaattgggtccttctgttttgttcttcggttgtagaaaccgtcgtatggacttcatctacgaagaagaattgcaaagatttgtcgaatctggtgctttggctgaattgtccgttgctttctctcgtgaaggtccaaccaaagaatacgttcaacacaagatgatggacaaagcctccgacatctggaacatgatctcccaaggtgcttacttgtacgtttgtggtgatgctaaaggtatggccagagatgtccacagatctttacataccattgcccaagaacaaggttccatggactccaccaaggctgaaggtttcgttaagaacttgcaaacttctggtcgttacttgagagatgtttgg

SEQ ID NO: 58 - protein, 711 aa, Arabidopsis thaliana
MSSSSSSSTSMIDLMAAIIKGEPVIVSDPANASAYESVAAELSSMLIENRQFAMIVTTSIAVLIGCIVMLVWRRSGSGNSKRVEPLKPLVIKPREEEIDDGRKKVTIFFGTQTGTAEGFAKALGEEAKARYEKTRFKIVDLDDYAADDDEYEEKLKKEDVAFFFLATYGDGEPTDNAARFYKWFTEGNDRGEWLKNLKYGVFGLGNRQYEHFNKVAKVVDDILVEQGAQRLVQVGLGDDDQCIEDDFTAWREALWPELDTILREEGDTAVATPYTAAVLEYRVSIHDSEDAKFNDINMANGNGYTVFDAQHPYKANVAVKRELHTPESDRSCIHLEFDIAGSGLTYETGDHVGVLCDNLSETVDEALRLLDMSPDTYFSLHAEKEDGTPISSSLPPPFPPCNLRTALTRYACLLSSPKKSALVALAAHASDPTEAERLKHLASPAGKDEYSKWVVESQRSLLEVMAEFPSAKPPLGVFFAGVAPRLQPRFYSISSSPKIAETRIHVTCALVYEKMPTGRIHKGVCSTWMKNAVPYEKSENCSSAPIFVRQSNFKLPSDSKVPIIMIGPGTGLAPFRGFLQERLALVESGVELGPSVLFFGCRNRRMDFIYEEELQRFVESGALAELSVAFSREGPTKEYVQHKMMDKASDIWNMISQGAYLYVCGDAKGMARDVHRSLHTIAQEQGSMDSTKAEGFVKNLQTSGRYLRDVW

SEQ ID NO: 59 - DNA, 2361 bp, Stevia rebaudiana
  CDS (1)..(2361)
atgaagactggtttcatctctccagctaccgtcttccaccacagaatctctccagctaccactttcagacaccacttgtccccagctaccactaactctactggtattgttgctttgagagacatcaacttcagatgtaaagctgtttccaaggaatactctgacttgttgcaaaaggatgaagcctccttcaccaaatgggatgatgacaaagttaaggaccatttagacactaacaagaacttgtacccaaacgatgaaatcaaggaattcgtcgaatctgtcaaagctatgttcggttccatgaatgatggtgaaatcaacgtttccgcttacgacaccgcttgggttgctttggttcaagacgttgatggttccggttctccacaattcccatcttctttggaatggattgccaacaaccaattgtctgatggttcttggggtgaccatttgttattctctgctcacgacagaattattaacactttagcttgtgtcattgctttgacttcctggaatgtccatccatccaagtgtgaaaagggtttgaacttcttgagagaaaacatctgtaagttggaagatgaaaatgctgaacacatgccaattggtttcgaagttaccttcccatctttgattgatatcgccaagaagttgaacatcgaagtcccagaagacaccccagctttgaaggaaatctacgccagaagagatatcaagttgaccaaaatcccaatggaagttttgcacaaggttccaaccaccttgttgcactctttggaaggtatgccagacttggaatgggaaaagttgttaaagttgcaatgtaaggacggttctttcttgttctctccatcttctaccgcctttgctttgatgcaaactaaggacgaaaagtgtctacaatacttaactaatatcgttaccaaattcaacggtggtgtcccaaacgtttaccctgttgacttgtttgaacacatctgggttgttgacagattgcaacgtttgggtattgctcgttatttcaagtctgaaatcaaggactgtgttgaatacatcaacaagtactggactaagaacggtatctgttgggctcgtaacacccacgttcaagatatcgacgacactgctatgggtttcagagtcttgagagctcatggttacgatgtcaccccagatgtcttcagacaattcgaaaaggatggtaagttcgtttgttttgccggtcaatccactcaagccgtcactggtatgttcaacgtctacagagcttctcaaatgttgttcccaggtgaaagaatcctagaagacgctaagaagttctcctacaactacttgaaagaaaagcaatctactaacgaattgttggacaaatggatcattgccaaagacttaccaggtgaagtcggttacgctttggatattccatggtacgcttctctaccaagattagaaaccagatactacttggaacaatacggtggtgaagacgatgtctggatcggtaagaccttgtacagaatgggttacgtttccaacaacacttacttggaaatggccaaattggactacaacaactacgtcgccgtcttacaattggaatggtacaccattcaacaatggtacgttgacattggtattgaaaagtttgaatccgacaacatcaagtccgtcttggtttcctactacttggctgctgcttccatctttgaaccagaaagatccaaggaaagaattgcttgggctaagaccaccatcttggttgacaagatcacttctattttcgactcttcccaatcttccaaggaagatatcaccgctttcattgacaaattcagaaacaagtcttcttccaagaagcactccattaacggtgaaccatggcacgaagttatggttgctttgaagaagactttgcacggttttgctttggatgctttgatgactcactctcaagatattcaccctcaattacaccaagcttgggaaatgtggttaaccaagttgcaagatggtgtcgatgtcactgctgaattgatggttcaaatgatcaacatgactgccggtagatgggtttctaaggaattgttgactcaccctcaataccaacgtttgtccaccgtcaccaactctgtctgtcacgacatcactaagttgcacaacttcaaagaaaactccactactgtcgattctaaggttcaagaattggttcaattagttttctctgacaccccagatgacttggaccaagacatgaagcaaactttcttgactgtcatgaagaccttctactacaaggcttggtgtgacccaaacaccatcaacgaccatatttctaaggtcttcgaaattgttatc

SEQ ID NO: 60 - protein, 787 aa, Stevia rebaudiana
MKTGFISPATVFHHRISPATTFRHHLSPATTNSTGIVALRDINFRCKAVSKEYSDLLQKDEASFTKWDDDKVKDHLDTNKNLYPNDEIKEFVESVKAMFGSMNDGEINVSAYDTAWVALVQDVDGSGSPQFPSSLEWIANNQLSDGSWGDHLLFSAHDRIINTLACVIALTSWNVHPSKCEKGLNFLRENICKLEDENAEHMPIGFEVTFPSLIDIAKKLNIEVPEDTPALKEIYARRDIKLTKIPMEVLHKVPTTLLHSLEGMPDLEWEKLLKLQCKDGSFLFSPSSTAFALMQTKDEKCLQYLTNIVTKFNGGVPNVYPVDLFEHIWVVDRLQRLGIARYFKSEIKDCVEYINKYWTKNGICWARNTHVQDIDDTAMGFRVLRAHGYDVTPDVFRQFEKDGKFVCFAGQSTQAVTGMFNVYRASQMLFPGERILEDAKKFSYNYLKEKQSTNELLDKWIIAKDLPGEVGYALDIPWYASLPRLETRYYLEQYGGEDDVWIGKTLYRMGYVSNNTYLEMAKLDYNNYVAVLQLEWYTIQQWYVDIGIEKFESDNIKSVLVSYYLAAASIFEPERSKERIAWAKTTILVDKITSIFDSSQSSKEDITAFIDKFRNKSSSKKHSINGEPWHEVMVALKKTLHGFALDALMTHSQDIHPQLHQAWEMWLTKLQDGVDVTAELMVQMINMTAGRWVSKELLTHPQYQRLSTVTNSVCHDITKLHNFKENSTTVDSKVQELVQLVFSDTPDDLDQDMKQTFLTVMKTFYYKAWCDPNTINDHISKVFEIVI

SEQ ID NO: 61 - DNA, 2229 bp, Stevia rebaudiana
  CDS (1)..(2229)
atgtgtaaagctgtttccaaggaatactctgacttgttgcaaaaggatgaagcctccttcaccaaatgggatgatgacaaagttaaggaccatttagacactaacaagaacttgtacccaaacgatgaaatcaaggaattcgtcgaatctgtcaaagctatgttcggttccatgaatgatggtgaaatcaacgtttccgcttacgacaccgcttgggttgctttggttcaagacgttgatggttccggttctccacaattcccatcttctttggaatggattgccaacaaccaattgtctgatggttcttggggtgaccatttgttattctctgctcacgacagaattattaacactttagcttgtgtcattgctttgacttcctggaatgtccatccatccaagtgtgaaaagggtttgaacttcttgagagaaaacatctgtaagttggaagatgaaaatgctgaacacatgccaattggtttcgaagttaccttcccatctttgattgatatcgccaagaagttgaacatcgaagtcccagaagacaccccagctttgaaggaaatctacgccagaagagatatcaagttgaccaaaatcccaatggaagttttgcacaaggttccaaccaccttgttgcactctttggaaggtatgccagacttggaatgggaaaagttgttaaagttgcaatgtaaggacggttctttcttgttctctccatcttctaccgcctttgctttgatgcaaactaaggacgaaaagtgtctacaatacttaactaatatcgttaccaaattcaacggtggtgtcccaaacgtttaccctgttgacttgtttgaacacatctgggttgttgacagattgcaacgtttgggtattgctcgttatttcaagtctgaaatcaaggactgtgttgaatacatcaacaagtactggactaagaacggtatctgttgggctcgtaacacccacgttcaagatatcgacgacactgctatgggtttcagagtcttgagagctcatggttacgatgtcaccccagatgtcttcagacaattcgaaaaggatggtaagttcgtttgttttgccggtcaatccactcaagccgtcactggtatgttcaacgtctacagagcttctcaaatgttgttcccaggtgaaagaatcctagaagacgctaagaagttctcctacaactacttgaaagaaaagcaatctactaacgaattgttggacaaatggatcattgccaaagacttaccaggtgaagtcggttacgctttggatattccatggtacgcttctctaccaagattagaaaccagatactacttggaacaatacggtggtgaagacgatgtctggatcggtaagaccttgtacagaatgggttacgtttccaacaacacttacttggaaatggccaaattggactacaacaactacgtcgccgtcttacaattggaatggtacaccattcaacaatggtacgttgacattggtattgaaaagtttgaatccgacaacatcaagtccgtcttggtttcctactacttggctgctgcttccatctttgaaccagaaagatccaaggaaagaattgcttgggctaagaccaccatcttggttgacaagatcacttctattttcgactcttcccaatcttccaaggaagatatcaccgctttcattgacaaattcagaaacaagtcttcttccaagaagcactccattaacggtgaaccatggcacgaagttatggttgctttgaagaagactttgcacggttttgctttggatgctttgatgactcactctcaagatattcaccctcaattacaccaagcttgggaaatgtggttaaccaagttgcaagatggtgtcgatgtcactgctgaattgatggttcaaatgatcaacatgactgccggtagatgggtttctaaggaattgttgactcaccctcaataccaacgtttgtccaccgtcaccaactctgtctgtcacgacatcactaagttgcacaacttcaaagaaaactccactactgtcgattctaaggttcaagaattggttcaattagttttctctgacaccccagatgacttggaccaagacatgaagcaaactttcttgactgtcatgaagaccttctactacaaggcttggtgtgacccaaacaccatcaacgaccatatttctaaggtcttcgaaattgttatc

SEQ ID NO: 62 - protein, 743 aa, Stevia rebaudiana
MCKAVSKEYSDLLQKDEASFTKWDDDKVKDHLDTNKNLYPNDEIKEFVESVKAMFGSMNDGEINVSAYDTAWVALVQDVDGSGSPQFPSSLEWIANNQLSDGSWGDHLLFSAHDRIINTLACVIALTSWNVHPSKCEKGLNFLRENICKLEDENAEHMPIGFEVTFPSLIDIAKKLNIEVPEDTPALKEIYARRDIKLTKIPMEVLHKVPTTLLHSLEGMPDLEWEKLLKLQCKDGSFLFSPSSTAFALMQTKDEKCLQYLTNIVTKFNGGVPNVYPVDLFEHIWVVDRLQRLGIARYFKSEIKDCVEYINKYWTKNGICWARNTHVQDIDDTAMGFRVLRAHGYDVTPDVFRQFEKDGKFVCFAGQSTQAVTGMFNVYRASQMLFPGERILEDAKKFSYNYLKEKQSTNELLDKWIIAKDLPGEVGYALDIPWYASLPRLETRYYLEQYGGEDDVWIGKTLYRMGYVSNNTYLEMAKLDYNNYVAVLQLEWYTIQQWYVDIGIEKFESDNIKSVLVSYYLAAASIFEPERSKERIAWAKTTILVDKITSIFDSSQSSKEDITAFIDKFRNKSSSKKHSINGEPWHEVMVALKKTLHGFALDALMTHSQDIHPQLHQAWEMWLTKLQDGVDVTAELMVQMINMTAGRWVSKELLTHPQYQRLSTVTNSVCHDITKLHNFKENSTTVDSKVQELVQLVFSDTPDDLDQDMKQTFLTVMKTFYYKAWCDPNTINDHISKVFEIVI

SEQ ID NO: 63 - DNA, 2352 bp, Stevia rebaudiana
  CDS (1)..(2352)
atgaacttgtctctatgtattgcttctccattattgaccaaatctaacagaccagccgctctatccgctattcacactgcctccacttctcacggtggtcaaaccaacccaaccaacttgattattgacaccaccaaggaaagaatccaaaagcaattcaagaatgttgaaatctccgtttcctcctacgacactgcttgggttgccatggttccatctccaaactccccaaagtctccatgtttcccagaatgtttgaactggttaatcaacaaccaattgaacgatggttcctggggtttagtcaatcacacccacaaccacaatcacccattgttgaaggactctctatcctccactttggcttgtatcgttgctttgaagagatggaacgttggtgaagaccaaatcaacaagggtttgtcctttattgaatccaacttggcttctgctactgaaaagtcccaaccatctcctatcggttttgacatcattttcccaggtttattggaatacgctaagaacttggacatcaacttattatctaagcaaaccgatttctccttgatgttgcacaagagagaattggaacaaaagagatgtcactccaacgaaatggacggttacttggcttacatttctgaaggtttgggtaacttgtacgactggaacatggtcaagaaataccaaatgaagaacggttccgttttcaactctccatctgctaccgctgctgctttcatcaaccatcaaaacccaggttgtttgaactacttgaactctttgttggacaaattcggtaacgctgttccaactgtctacccacacgatttgtttatcagattatccatggttgacaccattgaacgtttgggtatttctcatcacttcagagtcgaaatcaagaacgttttggatgaaacttacagatgttgggttgaaagagatgaacaaatcttcatggatgtcgtcacttgtgccttggccttcagattattgagaattaacggttacgaagtttctccagacccattggctgaaatcactaacgaattggctttgaaggacgaatacgccgctttggaaacttaccatgcctctcacatcttataccaagaagacttgtcctctggtaagcaaatcttgaagtctgctgacttcttgaaggaaattatctctactgattctaacagattgtccaagttgattcacaaggaagttgaaaacgccttgaaattcccaatcaacactggtttggaaagaattaacaccagaagaaacatccaattatacaacgttgacaacactagaatcttgaagactacttatcactcttccaacatctccaacactgactacttgagattggctgtcgaagatttctacacctgtcaatctatttacagagaagaattgaagggtttggaaagatgggttgtcgaaaacaaattggaccaattgaaatttgctagacaaaagaccgcctactgttacttctccgttgctgccactttgtcctctccagaattatctgacgccagaatctcctgggctaagaatggtatcttgaccaccgttgtcgatgacttcttcgatattggtggtaccattgacgaattgaccaacttgattcaatgtgttgaaaagtggaacgtcgatgtcgataaggactgttgttctgaacacgtcagaatcttattcttggctttgaaagatgctatctgttggatcggtgacgaagctttcaaatggcaagctcgtgacgttacctctcacgtcatccaaacctggttggaattgatgaactctatgttgagagaagccatctggacccgtgatgcttacgtcccaactttgaacgaatacatggaaaatgcttacgtttctttcgctttgggtccaattgtcaagcctgctatttacttcgttggtccaaagttgtccgaagaaattgttgaatcttctgaataccacaacttgttcaaattgatgtctactcaaggtcgtttgttgaacgatatccactctttcaagcgtgaattcaaggaaggtaagttgaatgctgttgctttgcatttgtctaacggtgaatctggtaaggtcgaagaagaagttgtcgaagaaatgatgatgatgatcaagaacaagagaaaggaattgatgaagttgatctttgaagaaaacggttctattgtcccaagagcttgtaaggatgctttctggaacatgtgtcacgtcttgaacttcttctacgctaacgatgacggtttcactggtaacaccatcttagacaccgtcaaggacatcatttacaacccattagtcttggttaacgaaaacgaagaacaaaga

SEQ ID NO: 64 - protein, 784 aa, Stevia rebaudiana
MNLSLCIASPLLTKSNRPAALSAIHTASTSHGGQTNPTNLIIDTTKERIQKQFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATEKSQPSPIGFDIIFPGLLEYAKNLDINLLSKQTDFSLMLHKRELEQKRCHSNEMDGYLAYISEGLGNLYDWNMVKKYQMKNGSVFNSPSATAAAFINHQNPGCLNYLNSLLDKFGNAVPTVYPHDLFIRLSMVDTIERLGISHHFRVEIKNVLDETYRCWVERDEQIFMDVVTCALAFRLLRINGYEVSPDPLAEITNELALKDEYAALETYHASHILYQEDLSSGKQILKSADFLKEIISTDSNRLSKLIHKEVENALKFPINTGLERINTRRNIQLYNVDNTRILKTTYHSSNISNTDYLRLAVEDFYTCQSIYREELKGLERWVVENKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 65 - DNA, 2271 bp, Stevia rebaudiana
  CDS (1)..(2271)
atgacttctcacggtggtcaaaccaacccaaccaacttgattattgacaccaccaaggaaagaatccaaaagcaattcaagaatgttgaaatctccgtttcctcctacgacactgcttgggttgccatggttccatctccaaactccccaaagtctccatgtttcccagaatgtttgaactggttaatcaacaaccaattgaacgatggttcctggggtttagtcaatcacacccacaaccacaatcacccattgttgaaggactctctatcctccactttggcttgtatcgttgctttgaagagatggaacgttggtgaagaccaaatcaacaagggtttgtcctttattgaatccaacttggcttctgctactgaaaagtcccaaccatctcctatcggttttgacatcattttcccaggtttattggaatacgctaagaacttggacatcaacttattatctaagcaaaccgatttctccttgatgttgcacaagagagaattggaacaaaagagatgtcactccaacgaaatggacggttacttggcttacatttctgaaggtttgggtaacttgtacgactggaacatggtcaagaaataccaaatgaagaacggttccgttttcaactctccatctgctaccgctgctgctttcatcaaccatcaaaacccaggttgtttgaactacttgaactctttgttggacaaattcggtaacgctgttccaactgtctacccacacgatttgtttatcagattatccatggttgacaccattgaacgtttgggtatttctcatcacttcagagtcgaaatcaagaacgttttggatgaaacttacagatgttgggttgaaagagatgaacaaatcttcatggatgtcgtcacttgtgccttggccttcagattattgagaattaacggttacgaagtttctccagacccattggctgaaatcactaacgaattggctttgaaggacgaatacgccgctttggaaacttaccatgcctctcacatcttataccaagaagacttgtcctctggtaagcaaatcttgaagtctgctgacttcttgaaggaaattatctctactgattctaacagattgtccaagttgattcacaaggaagttgaaaacgccttgaaattcccaatcaacactggtttggaaagaattaacaccagaagaaacatccaattatacaacgttgacaacactagaatcttgaagactacttatcactcttccaacatctccaacactgactacttgagattggctgtcgaagatttctacacctgtcaatctatttacagagaagaattgaagggtttggaaagatgggttgtcgaaaacaaattggaccaattgaaatttgctagacaaaagaccgcctactgttacttctccgttgctgccactttgtcctctccagaattatctgacgccagaatctcctgggctaagaatggtatcttgaccaccgttgtcgatgacttcttcgatattggtggtaccattgacgaattgaccaacttgattcaatgtgttgaaaagtggaacgtcgatgtcgataaggactgttgttctgaacacgtcagaatcttattcttggctttgaaagatgctatctgttggatcggtgacgaagctttcaaatggcaagctcgtgacgttacctctcacgtcatccaaacctggttggaattgatgaactctatgttgagagaagccatctggacccgtgatgcttacgtcccaactttgaacgaatacatggaaaatgcttacgtttctttcgctttgggtccaattgtcaagcctgctatttacttcgttggtccaaagttgtccgaagaaattgttgaatcttctgaataccacaacttgttcaaattgatgtctactcaaggtcgtttgttgaacgatatccactctttcaagcgtgaattcaaggaaggtaagttgaatgctgttgctttgcatttgtctaacggtgaatctggtaaggtcgaagaagaagttgtcgaagaaatgatgatgatgatcaagaacaagagaaaggaattgatgaagttgatctttgaagaaaacggttctattgtcccaagagcttgtaaggatgctttctggaacatgtgtcacgtcttgaacttcttctacgctaacgatgacggtttcactggtaacaccatcttagacaccgtcaaggacatcatttacaacccattagtcttggttaacgaaaacgaagaacaaaga

SEQ ID NO: 66 - protein, 757 aa, Stevia rebaudiana
MTSHGGQTNPTNLIIDTTKERIQKQFKNVEISVSSYDTAWVAMVPSPNSPKSPCFPECLNWLINNQLNDGSWGLVNHTHNHNHPLLKDSLSSTLACIVALKRWNVGEDQINKGLSFIESNLASATEKSQPSPIGFDIIFPGLLEYAKNLDINLLSKQTDFSLMLHKRELEQKRCHSNEMDGYLAYISEGLGNLYDWNMVKKYQMKNGSVFNSPSATAAAFINHQNPGCLNYLNSLLDKFGNAVPTVYPHDLFIRLSMVDTIERLGISHHFRVEIKNVLDETYRCWVERDEQIFMDVVTCALAFRLLRINGYEVSPDPLAEITNELALKDEYAALETYHASHILYQEDLSSGKQILKSADFLKEIISTDSNRLSKLIHKEVENALKFPINTGLERINTRRNIQLYNVDNTRILKTTYHSSNISNTDYLRLAVEDFYTCQSIYREELKGLERWVVENKLDQLKFARQKTAYCYFSVAATLSSPELSDARISWAKNGILTTVVDDFFDIGGTIDELTNLIQCVEKWNVDVDKDCCSEHVRILFLALKDAICWIGDEAFKWQARDVTSHVIQTWLELMNSMLREAIWTRDAYVPTLNEYMENAYVSFALGPIVKPAIYFVGPKLSEEIVESSEYHNLFKLMSTQGRLLNDIHSFKREFKEGKLNAVALHLSNGESGKVEEEVVEEMMMMIKNKRKELMKLIFEENGSIVPRACKDAFWNMCHVLNFFYANDDGFTGNTILDTVKDIIYNPLVLVNENEEQR

SEQ ID NO: 67 - DNA, 1539 bp, Stevia rebaudiana
  CDS (1)..(1539)
atggatgctgtcactggtttgttgaccgtcccagctaccgccatcaccattggtggtactgctgttgctttggctgttgctttgatcttctggtacttgaaatcttacacttctgccagaagatctcaatctaaccatttaccaagagttccagaagttccaggtgttccattgttgggtaacttgttgcaattgaaagaaaagaagccttacatgactttcaccagatgggctgctacctacggtccaatttactctatcaagaccggtgctacctccatggttgttgtttcctccaacgaaattgccaaggaagctttagtcaccagattccaatccatctctaccagaaacttgtccaaggctttgaaggtcttgactgctgacaagaccatggttgccatgtctgactacgatgactaccacaagactgtcaaacgtcacatcttgactgctgttttgggtccaaatgctcaaaagaagcacagaattcacagagatatcatgatggacaacatctctactcaattgcatgaatttgtcaagaacaacccagaacaagaagaagtcgatttgagaaagatcttccaatctgaattgttcggtttggccatgagacaagctttgggtaaagatgtcgaatctttatacgtcgaagatttgaagatcaccatgaacagagatgaaatcttccaagttttggttgtcgacccaatgatgggtgccattgatgttgactggagagatttcttcccatacttgaaatgggttccaaacaagaagttcgaaaataccattcaacaaatgtacatccgtcgtgaagctgtcatgaagtctttaatcaaggaaaacaagaagagaattgcttctggtgaaaagttaaactcctacattgactatttgttgtccgaagctcaaactttgactgaccaacaattattgatgtctttatgggaaccaatcattgaatcttctgacaccaccatggtcactactgaatgggctatgtacgaattggccaagaacccaaaattacaagaccgtttgtacagagatatcaaatccgtctgtggttccgaaaagatcactgaagaacacttgtctcaattgccatacatcactgctatcttccacgaaactttgagaagacactctccagttccaatcattccattgagacacgtccacgaagacactgttttgggtggttaccacgttccagctggtactgaattggctgtcaacatctacggttgtaacatggacaagaacgtctgggaaaacccagaagaatggaacccagaaagattcatgaaggaaaacgaaaccattgacttccaaaagaccatggctttcggtggtggtaagagagtttgtgccggttccttgcaagctctattgaccgcttccattggtattggtagaatggttcaagaatttgaatggaagttgaaggacatgacccaagaagaagttaacaccattggtttgactactcaaatgttaagaccattgagagccatcatcaagcctcgcatc

SEQ ID NO: 68 - protein, 513 aa, Stevia rebaudiana
MDAVTGLLTVPATAITIGGTAVALAVALIFWYLKSYTSARRSQSNHLPRVPEVPGVPLLGNLLQLKEKKPYMTFTRWAATYGPIYSIKTGATSMVVVSSNEIAKEALVTRFQSISTRNLSKALKVLTADKTMVAMSDYDDYHKTVKRHILTAVLGPNAQKKHRIHRDIMMDNISTQLHEFVKNNPEQEEVDLRKIFQSELFGLAMRQALGKDVESLYVEDLKITMNRDEIFQVLVVDPMMGAIDVDWRDFFPYLKWVPNKKFENTIQQMYIRREAVMKSLIKENKKRIASGEKLNSYIDYLLSEAQTLTDQQLLMSLWEPIIESSDTTMVTTEWAMYELAKNPKLQDRLYRDIKSVCGSEKITEEHLSQLPYITAIFHETLRRHSPVPIIPLRHVHEDTVLGGYHVPAGTELAVNIYGCNMDKNVWENPEEWNPERFMKENETIDFQKTMAFGGGKRVCAGSLQALLTASIGIGRMVQEFEWKLKDMTQEEVNTIGLTTQMLRPLRAIIKPRI

SEQ ID NO: 69 - DNA, 1566 bp, Stevia rebaudiana
  CDS (1)..(1566)
atgggtttgttcccattggaagactcttacgctttggttttcgaaggtttggccatcactttggctttgtactacctattgtctttcatctacaagacctccaagaagacctgtaccccaccaaaggcttctggtgaacacccaattaccggtcatttaaacttgttgtctggttcttccggtttgccacacttggctttggcttctttggctgacagatgtggtcctatcttcaccatcagattaggtatcagaagagttttggttgtttccaactgggaaattgccaaggaaatctttaccacccacgacttgattgtctccaacagaccaaagtacttggctgccaagatcttaggtttcaactacgtttctttctctttcgctccatacggtccatactgggttggtatcagaaagattattgctactaaattgatgtcttcttctagattgcaaaagttgcaattcgtccgtgtctttgaattggaaaactccatgaaatccatcagagaatcctggaaggaaaagaaggatgaagaaggtaaggtcttggttgaaatgaagaagtggttctgggaattgaatatgaacattgtcttgagaaccgttgctggtaagcaatacactggtactgttgacgatgctgatgccaagagaatttctgaattgttcagagaatggttccactacactggtagattcgttgtcggtgatgctttcccatttctaggttggttggatttaggtggttacaagaagaccatggaattggttgcctccagattagattccatggtcagcaaatggttggacgaacacagaaagaagcaagctaacgatgacaagaaggaagacatggacttcatggacatcatgatctccatgactgaagctaactctccattggaaggttacggtactgacaccatcatcaagaccacttgtatgactttgattgtttccggtgtcgacaccacttctatcgttttgacctgggctttgtctttgttgttgaacaacagagacactttaaagaaggctcaagaagaattggacatgtgtgtcggtaagggtagacaagtcaatgaatctgatttggtcaacttaatctatttagaagctgtcttgaaagaagctttgagattgtacccagctgctttcttgggtggtcctcgtgctttcttggaagactgtaccgttgccggttacagaattccaaagggtacttgtttgttgatcaacatgtggaaattgcacagagatccaaacatctggtctgacccatgtgaattcaaaccagaaagattcttgactccaaaccaaaaggatgttgatgtcattggtatggacttcgaattgattccattcggtgctggtcgtcgttactgtccaggtaccagattagctttgcaaatgttgcacattgtcttggccactctattacaaaactttgaaatgtccactccaaacgatgctccagttgacatgactgcttccgttggtatgaccaacgccaaggcttctccattggaagttttgttgtctccaagagtcaaatggtct

SEQ ID NO: 70 - protein, 522 aa, Stevia rebaudiana
MGLFPLEDSYALVFEGLAITLALYYLLSFIYKTSKKTCTPPKASGEHPITGHLNLLSGSSGLPHLALASLADRCGPIFTIRLGIRRVLVVSNWEIAKEIFTTHDLIVSNRPKYLAAKILGFNYVSFSFAPYGPYWVGIRKIIATKLMSSSRLQKLQFVRVFELENSMKSIRESWKEKKDEEGKVLVEMKKWFWELNMNIVLRTVAGKQYTGTVDDADAKRISELFREWFHYTGRFVVGDAFPFLGWLDLGGYKKTMELVASRLDSMVSKWLDEHRKKQANDDKKEDMDFMDIMISMTEANSPLEGYGTDTIIKTTCMTLIVSGVDTTSIVLTWALSLLLNNRDTLKKAQEELDMCVGKGRQVNESDLVNLIYLEAVLKEALRLYPAAFLGGPRAFLEDCTVAGYRIPKGTCLLINMWKLHRDPNIWSDPCEFKPERFLTPNQKDVDVIGMDFELIPFGAGRRYCPGTRLALQMLHIVLATLLQNFEMSTPNDAPVDMTASVGMTNAKASPLEVLLSPRVKWS

SEQ ID NO: 71 - DNA, 1443 bp, Stevia rebaudiana
  CDS (1)..(1443)
atggacgctatggccaccactgaaaagaagcctcacgttatctttattccattcccagctcaatctcatatcaaggctatgttgaaattggctcaattattgcaccacaagggtttgcaaatcacttttgtcaacaccgacttcattcacaaccaattcttggaatcttctggtcctcactgtttggacggtgctccaggtttcagattcgaaaccattccagatggtgtttcccactctccagaagcctccatcccaatcagagaatccttgttgagatctattgaaaccaacttcttggaccgtttcatcgatttggttaccaaattgccagacccaccaacctgtatcatttctgacggtttcttgtccgttttcaccatcgatgctgccaagaaattgggtattccagtcatgatgtactggactttggctgcttgtggtttcatgggtttctaccatattcactctttgattgaaaagggtttcgctccattaaaggatgcttcttacttgaccaacggttacttggacaccgtcattgactgggttccaggtatggaaggtatcagattgaaagatttcccattggactggtctactgacttgaatgacaaggtcttgatgttcactactgaagctccacaaagatctcataaggtttctcaccacatcttccacactttcgatgaattagaaccatctatcatcaagactctatccttgagatacaaccatatctacaccattggtccattacaattgttgttggaccaaatcccagaagaaaagaagcaaaccggtatcacttctttgcacggttactctttagtcaaggaagaaccagaatgtttccaatggttacaatccaaggaaccaaactctgttgtctacgttaactttggttccaccactgttatgtccttggaagatatgactgaatttggttggggtttggctaactctaaccactacttcttatggatcatcagatctaacttggtcattggtgaaaacgccgttttgcctccagaattggaagaacacatcaagaagagaggtttcattgcttcctggtgttctcaagaaaaggtcttgaagcacccatctgttggtggtttcttgacccactgtggttggggttccaccattgaatccctatctgctggtgttccaatgatctgttggccatactcctgggaccaattgactaactgtcgttacatctgtaaggaatgggaagttggtttggaaatgggtactaaggtcaagagagatgaagtcaagagattagtccaagaattgatgggtgaaggtggtcacaagatgagaaacaaagccaaggactggaaggaaaaggccagaattgctattgctccaaacggttcttcctccttgaacatcgataaaatggttaaggaaatcactgtcttggctcgaaac

SEQ ID NO: 72 - protein, 481 aa, Stevia rebaudiana
MDAMATTEKKPHVIFIPFPAQSHIKAMLKLAQLLHHKGLQITFVNTDFIHNQFLESSGPHCLDGAPGFRFETIPDGVSHSPEASIPIRESLLRSIETNFLDRFIDLVTKLPDPPTCIISDGFLSVFTIDAAKKLGIPVMMYWTLAACGFMGFYHIHSLIEKGFAPLKDASYLTNGYLDTVIDWVPGMEGIRLKDFPLDWSTDLNDKVLMFTTEAPQRSHKVSHHIFHTFDELEPSIIKTLSLRYNHIYTIGPLQLLLDQIPEEKKQTGITSLHGYSLVKEEPECFQWLQSKEPNSVVYVNFGSTTVMSLEDMTEFGWGLANSNHYFLWIIRSNLVIGENAVLPPELEEHIKKRGFIASWCSQEKVLKHPSVGGFLTHCGWGSTIESLSAGVPMICWPYSWDQLTNCRYICKEWEVGLEMGTKVKRDEVKRLVQELMGEGGHKMRNKAKDWKEKARIAIAPNGSSSLNIDKMVKEITVLARN

SEQ ID NO: 73 - DNA, 1380 bp, Stevia rebaudiana
  CDS (1)..(1380)
atggctgaacaacaaaagatcaagaaatctccacacgtcttgttgattccattcccattgcaaggtcacatcaacccattcatccaattcggtaagagattgatttccaagggtgtcaagaccactttagtcaccactattcacactttaaactccactttaaaccactctaacactactaccacctctattgaaatccaagccatttctgacggttgtgacgaaggtggtttcatgtctgctggtgaatcttacttggaaactttcaagcaagtcggttccaagtctttggctgatttgatcaagaaattgcaatccgaaggtactaccatcgatgctatcatctacgactccatgactgaatgggttttggatgttgccattgaatttggtattgacggtggttctttcttcacccaagcctgtgttgttaactctttgtactaccacgtccacaagggtttgatctctctaccattaggtgaaaccgtttccgtcccaggtttcccagtcttgcaaagatgggaaactccattgatcttacaaaaccatgaacaaatccaatctccatggtcccaaatgttgtttggtcaattcgctaacattgaccaagctagatgggttttcaccaactctttctacaagttggaagaagaagtcattgaatggaccagaaagatctggaacttgaaggttatcggtccaactctaccatccatgtacttggacaagagattggatgacgacaaggacaacggtttcaacttgtacaaggctaaccatcacgaatgtatgaactggttggatgacaagccaaaggaatctgttgtttacgttgctttcggttctttggtcaagcatggtccagaacaagttgaagaaatcaccagagctttgattgactccgatgttaacttcttatgggttatcaagcacaaggaagaaggtaaattgccagaaaacttgtctgaagttatcaagaccggtaagggtttgattgttgcttggtgtaagcaattggatgttttggctcacgaatccgtcggttgtttcgtcactcactgtggtttcaactctactttggaagctatctccttgggtgttccagttgttgccatgcctcaattctctgaccaaaccaccaacgccaaattgttggatgaaatcttgggtgtcggtgtccgtgtcaaggctgatgaaaacggtattgttagaagaggtaacttagcttcctgtatcaagatgatcatggaagaagaacgtggtgtcattatcagaaagaatgctgtcaaatggaaggacttggctaaggttgctgtccacgaaggtggttcctctgacaatgacattgttgaatttgtctctgaattgatcaaagcg

SEQ ID NO: 74 - protein, 460 aa, Stevia rebaudiana
MAEQQKIKKSPHVLLIPFPLQGHINPFIQFGKRLISKGVKTTLVTTIHTLNSTLNHSNTTTTSIEIQAISDGCDEGGFMSAGESYLETFKQVGSKSLADLIKKLQSEGTTIDAIIYDSMTEWVLDVAIEFGIDGGSFFTQACVVNSLYYHVHKGLISLPLGETVSVPGFPVLQRWETPLILQNHEQIQSPWSQMLFGQFANIDQARWVFTNSFYKLEEEVIEWTRKIWNLKVIGPTLPSMYLDKRLDDDKDNGFNLYKANHHECMNWLDDKPKESVVYVAFGSLVKHGPEQVEEITRALIDSDVNFLWVIKHKEEGKLPENLSEVIKTGKGLIVAWCKQLDVLAHESVGCFVTHCGFNSTLEAISLGVPVVAMPQFSDQTTNAKLLDEILGVGVRVKADENGIVRRGNLASCIKMIMEEERGVIIRKNAVKWKDLAKVAVHEGGSSDNDIVEFVSELIKA

SEQ ID NO: 75 - DNA, 1374 bp, Stevia rebaudiana
  CDS (1)..(1374)
atggaaaacaagactgaaaccactgttagaagaagaagaagaatcatcttattcccagttccattccaaggtcacattaacccaatcttgcaattggctaacgtcttatactccaagggtttctccatcaccatcttccacaccaacttcaacaaacctaaaacttccaactacccacacttcaccttcagatttatcttggacaacgacccacaagatgaaagaatttctaacttgccaacccatggtccattggccggtatgagaattccaatcatcaacgaacacggtgctgacgaattgagaagagaattggaattgttgatgttggcttctgaagaagatgaagaagtctcttgtttgatcactgatgctttatggtactttgctcaatctgttgctgactctttgaacttgagaagattagtcttgatgacctcttctttgttcaacttccacgctcacgtttctctaccacaatttgatgaattgggttacttggacccagatgacaagaccagattggaagaacaagcctccggtttcccaatgttgaaggtcaaggatatcaagtctgcctactccaactggcaaatcttgaaggaaattttgggtaagatgatcaagcaaaccaaggcttcttctggtgtcatctggaactccttcaaggaattggaagaatctgaattggaaaccgtcatcagagaaattccagctccatctttcttgattccattaccaaagcatttgactgcttcctcctcttctctattggaccacgacagaactgttttccaatggttggaccaacaaccaccatcttccgtcttatacgtttcctttggttccacttctgaagttgacgaaaaggacttcttggaaattgctcgtggtttggttgactccaagcaatctttcttatgggttgtcagaccaggtttcgtcaagggttccacctgggttgaacctttgccagacggtttcttgggtgaaagaggtagaattgtcaaatgggttccacaacaagaagttttggctcacggtgccattggtgctttctggactcactctggttggaactctactttggaatccgtttgtgaaggtgttccaatgattttctctgacttcggtttggaccaaccattgaatgctcgttacatgtccgatgttttgaaggttggtgtctacttggaaaacggttgggaacgtggtgaaattgctaacgccatcagaagagtcatggtcgatgaagaaggtgaatacatcagacaaaatgctcgtgtcttgaaacaaaaggctgatgtttctttgatgaagggtggttcttcttacgaatctttggaatctttggtttcctacatctccagtctc

SEQ ID NO: 76 - protein, 458 aa, Stevia rebaudiana
MENKTETTVRRRRRIILFPVPFQGHINPILQLANVLYSKGFSITIFHTNFNKPKTSNYPHFTFRFILDNDPQDERISNLPTHGPLAGMRIPIINEHGADELRRELELLMLASEEDEEVSCLITDALWYFAQSVADSLNLRRLVLMTSSLFNFHAHVSLPQFDELGYLDPDDKTRLEEQASGFPMLKVKDIKSAYSNWQILKEILGKMIKQTKASSGVIWNSFKELEESELETVIREIPAPSFLIPLPKHLTASSSSLLDHDRTVFQWLDQQPPSSVLYVSFGSTSEVDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 77 - DNA, 2130 bp, Stevia rebaudiana
  CDS (1)..(2130)
atgcaatctgattccgttaaggtttctccattcgacttagtctctgctgccatgaacggtaaggctatggaaaagttgaacgcttctgaatctgaggacccaactactttaccagctttaaagatgttggttgaaaacagagaattgttgactttattcaccacctcctttgctgtcttgattggttgtttggttttcttgatgtggagaagatcttcttctaagaagttggttcaagacccagttcctcaagtcatcgtcgtcaagaagaaggaaaaggaatctgaagtcgatgacggtaagaagaaagtttccatcttctacggtactcaaaccggtactgctgaaggtttcgctaaagctttagttgaagaagctaaggtcagatacgaaaagacctctttcaaggttatcgatttggacgactacgccgctgacgacgacgaatacgaagaaaagttgaagaaggaatctctagctttcttcttcttggctacctacggtgacggtgaaccaaccgacaatgctgccaacttctacaaatggttcaccgaaggtgatgacaagggtgaatggttgaagaaattgcaatacggtgttttcggtttaggtaacagacaatacgaacacttcaacaagattgccatcgtcgttgatgacaaattgactgaaatgggtgccaagagattggttccagtcggtttgggtgatgatgaccaatgtattgaagatgactttaccgcttggaaggaattagtttggccagaattagaccaattgttgagagatgaagatgacacctctgttaccaccccatacaccgccgctgtcttggaataccgtgtcgtttaccatgacaaaccagctgactcttacgctgaagatcaaacccacaccaacggtcacgttgtccacgacgctcaacacccatccagatctaacgttgctttcaagaaggaattgcacacttcccaatctgatcgttcttgtacccacttggaatttgacatctcccacaccggtttgtcttacgaaaccggtgaccatgttggtgtctactctgaaaacttgtctgaagttgtcgacgaagctttgaaattgttgggtttgtctccagacacttacttctccgtccacgctgacaaagaagatggtactccaatcggtggtgcttctttgcctccaccattcccaccatgtactctaagagatgctttgacccgttatgctgacgttctatcctctccaaagaaggttgctttgttggctttggctgctcatgcttctgatccatctgaagctgacagattgaagttcttggcttccccagccggtaaggacgaatacgctcaatggattgttgccaaccaaagatccttgttggaagtcatgcaatctttcccatctgccaagcctccattgggtgttttctttgccgctgttgccccaagattgcaaccaagatactactccatctcctcttctccaaagatgtccccaaacagaattcacgtcacttgtgctttggtttacgaaaccactccagctggtagaattcacagaggtttgtgttccacctggatgaagaatgccgtcccattaactgaatctccagactgttcccaagcttctatcttcgtcagaacttccaacttcagattgccagtcgatccaaaggtcccagttatcatgatcggtccaggtactggtttggctccattcagaggtttcttgcaagaaagattagctttgaaagaatctggtactgaattgggttcctccatcttcttcttcggttgtagaaacagaaaggtcgattttatctacgaagatgaattgaacaacttcgttgaaactggtgctttgtctgaattgattgtcgctttctccagagaaggtactgccaaggaatacgtccaacacaagatgtcccaaaaggcttctgatatctggaagttgttgtctgaaggtgcttacttgtacgtttgtggtgatgctaaaggtatggccaaggacgttcacagaactttgcacactattgttcaagaacaaggttctttggactcctccaaggctgaattatacgtcaagaacttgcaaatgtccggtcgttacttgagagatgtatgg

SEQ ID NO: 78 - protein, 710 aa, Stevia rebaudiana
MQSDSVKVSPFDLVSAAMNGKAMEKLNASESEDPTTLPALKMLVENRELLTLFTTSFAVLIGCLVFLMWRRSSSKKLVQDPVPQVIVVKKKEKESEVDDGKKKVSIFYGTQTGTAEGFAKALVEEAKVRYEKTSFKVIDLDDYAADDDEYEEKLKKESLAFFFLATYGDGEPTDNAANFYKWFTEGDDKGEWLKKLQYGVFGLGNRQYEHFNKIAIVVDDKLTEMGAKRLVPVGLGDDDQCIEDDFTAWKELVWPELDQLLRDEDDTSVTTPYTAAVLEYRVVYHDKPADSYAEDQTHTNGHVVHDAQHPSRSNVAFKKELHTSQSDRSCTHLEFDISHTGLSYETGDHVGVYSENLSEVVDEALKLLGLSPDTYFSVHADKEDGTPIGGASLPPPFPPCTLRDALTRYADVLSSPKKVALLALAAHASDPSEADRLKFLASPAGKDEYAQWIVANQRSLLEVMQSFPSAKPPLGVFFAAVAPRLQPRYYSISSSPKMSPNRIHVTCALVYETTPAGRIHRGLCSTWMKNAVPLTESPDCSQASIFVRTSNFRLPVDPKVPVIMIGPGTGLAPFRGFLQERLALKESGTELGSSIFFFGCRNRKVDFIYEDELNNFVETGALSELIVAFSREGTAKEYVQHKMSQKASDIWKLLSEGAYLYVCGDAKGMAKDVHRTLHTIVQEQGSLDSSKAELYVKNLQMSGRYLRDVW

SEQ ID NO: 79 - DNA, 1575 bp, Saccharomyces cerevisiae
  CDS (1)..(1575)
atggaccaattggtcaagactgaagtcaccaagaaatctttcactgctccagtccaaaaggcttccactccagttttgaccaacaagaccgtcatctccggttccaaggttaaatctttgtcctctgctcaatcttcctcctctggtccatcttcttcttctgaagaagatgattccagagatatcgaatctttggacaagaaaatcagaccattggaagaattggaagctctattgtcctctggtaacactaagcaattaaagaacaaggaagttgctgctttggttatccacggtaaattgccattgtacgctttggaaaagaaattaggtgacaccaccagagctgttgctgtcagaagaaaggctttgtccattttggctgaagctccagtcttggcttccgacagattaccatacaagaactacgactacgaccgtgtctttggtgcttgttgtgaaaatgtcattggttacatgccattaccagttggtgtcattggtccattggttatcgacggtacttcttaccacatcccaatggctaccactgaaggttgtttggttgcttctgccatgagaggttgtaaggccatcaacgctggtggtggtgctaccaccgttttgactaaggatggtatgaccagaggtcctgttgtcagattcccaactttgaagagatctggtgcttgtaagatctggttggattctgaagaaggtcaaaacgccatcaagaaggctttcaactccacttccagattcgctagattgcaacacattcaaacttgtttagctggtgacttgttgttcatgagattcagaaccaccactggtgacgctatgggtatgaacatgatctccaagggtgttgaatactctttgaagcaaatggttgaagaatacggttgggaagatatggaagttgtctctgtttctggtaactactgtaccgacaagaagccagctgccatcaactggatcgaaggtcgtggtaagtccgttgttgctgaagctaccattccaggtgacgttgtcagaaaggttttgaaatctgatgtttctgctttagtcgaattgaacattgccaagaacttggtcggttctgccatggctggttccgtcggtggtttcaacgctcatgccgctaacttggtcactgctgttttcttggctttaggtcaagatccagctcaaaatgtcgaatcctctaactgtatcactttgatgaaggaagttgacggtgatttgagaatttctgtttccatgccatccattgaagtcggtactatcggtggtggtactgtcttggaaccacaaggtgccatgttggacttgttgggtgttcgtggtccacacgctaccgctccaggtactaacgccagacaattggccagaattgttgcctgtgccgtcttggctggtgaattgtctctatgtgccgctttggctgctggtcacttggttcaatctcacatgacccacaacagaaagcctgctgaaccaaccaaaccaaacaacttggatgctactgacattaacagattaaaggacggttctgtcacctgtatcaagtct

SEQ ID NO: 80 - protein, 525 aa, Saccharomyces cerevisiae
MDQLVKTEVTKKSFTAPVQKASTPVLTNKTVISGSKVKSLSSAQSSSSGPSSSSEEDDSRDIESLDKKIRPLEELEALLSSGNTKQLKNKEVAALVIHGKLPLYALEKKLGDTTRAVAVRRKALSILAEAPVLASDRLPYKNYDYDRVFGACCENVIGYMPLPVGVIGPLVIDGTSYHIPMATTEGCLVASAMRGCKAINAGGGATTVLTKDGMTRGPVVRFPTLKRSGACKIWLDSEEGQNAIKKAFNSTSRFARLQHIQTCLAGDLLFMRFRTTTGDAMGMNMISKGVEYSLKQMVEEYGWEDMEVVSVSGNYCTDKKPAAINWIEGRGKSVVAEATIPGDVVRKVLKSDVSALVELNIAKNLVGSAMAGSVGGFNAHAANLVTAVFLALGQDPAQNVESSNCITLMKEVDGDLRISVSMPSIEVGTIGGGTVLEPQGAMLDLLGVRGPHATAPGTNARQLARIVACAVLAGELSLCAALAAGHLVQSHMTHNRKPAEPTKPNNLDATDINRLKDGSVTCIKS

SEQ ID NO: 81 - DNA, 1056 bp, Saccharomyces cerevisiae
  CDS (1)..(1056)
atggcttctgaaaaggaaatcagaagagaacgtttcttgaatgttttcccaaaattggttgaagaattgaacgcttctctattagcttacggtatgccaaaggaagcttgtgactggtacgctcactctttgaactacaacaccccaggtggtaagttgaacagaggtctatccgttgttgacacctacgccattttgtccaacaagaccgtcgaacaattaggtcaagaagaatacgaaaaggttgccatcttaggttggtgtatcgaattgttgcaagcttacttcttggttgctgatgacatgatggacaaatctatcaccagaagaggtcaaccatgttggtacaaggttccagaagtcggtgaaattgccatcaacgatgctttcatgttggaagctgccatctacaagttgttgaagtctcacttcagaaacgaaaagtactacattgacatcactgaattattccacgaagttactttccaaaccgaattgggtcaattgatggacttgattaccgctccagaagataaggtcgatttgtccaaattttccttgaagaaacactctttcattgtcactttcaagactgcttactactccttttacttgcctgttgctttggccatgtatgtcgctggtatcaccgatgaaaaggacttgaagcaagctcgtgatgtcttgattccattaggtgaatacttccaaatccaagatgactacttggactgtttcggtactccagaacaaatcggtaagattggtactgatatccaagacaacaagtgttcctgggttatcaacaaggctttggaattggcttctgctgaacaaagaaagactttggacgaaaactacggtaagaaggactctgttgctgaagctaagtgtaagaagatcttcaacgatttgaaaattgaacaattataccatgaatacgaagaatctattgccaaggacttgaaagccaagatctctcaagtcgacgaatccagaggtttcaaggctgatgtcttgactgctttcttgaacaaggtctacaagagatcaaaa

SEQ ID NO: 82 - protein, 352 aa, Saccharomyces cerevisiae
MASEKEIRRERFLNVFPKLVEELNASLLAYGMPKEACDWYAHSLNYNTPGGKLNRGLSVVDTYAILSNKTVEQLGQEEYEKVAILGWCIELLQAYFLVADDMMDKSITRRGQPCWYKVPEVGEIAINDAFMLEAAIYKLLKSHFRNEKYYIDITELFHEVTFQTELGQLMDLITAPEDKVDLSKFSLKKHSFIVTFKTAYYSFYLPVALAMYVAGITDEKDLKQARDVLIPLGEYFQIQDDYLDCFGTPEQIGKIGTDIQDNKCSWVINKALELASAEQRKTLDENYGKKDSVAEAKCKKIFNDLKIEQLYHEYEESIAKDLKAKISQVDESRGFKADVLTAFLNKVYKRSK

SEQ ID NO: 83 - DNA, 1005 bp, Saccharomyces cerevisiae
  CDS (1)..(1005)
atggaagctaagattgacgaattgatcaacaacgaccctgtctggtcctctcaaaacgaatctttgatctccaagccatacaaccacatcttgttgaagccaggtaagaacttcagattaaacttgattgttcaaatcaacagagttatgaacttgccaaaggaccaattggccattgtttcccaaattgtcgaattgttgcacaactcctctctattgatcgatgacattgaagataatgctccattaagaagaggtcaaaccacttctcatttgattttcggtgtcccatccaccatcaacactgctaactacatgtacttcagagccatgcaattggtttctcaattgaccaccaaggaaccattataccacaacttgatcactatctttaacgaagaattgattaacttgcaccgtggtcaaggtttggacatctactggagagatttcttgccagaaattattccaactcaagaaatgtacttgaacatggtcatgaacaagactggtggtttattcagattgactttacgtttgatggaagctttgtctccatcttcccaccacggtcactctttggttccattcatcaatctattaggtatcatctaccaaatcagagatgattacttgaacttgaaggacttccaaatgtcctctgaaaagggtttcgctgaagatatcactgaaggtaaattgtctttcccaattgtccacgccttgaactttaccaagaccaagggtcaaactgaacaacacaacgaaattttgagaatcttattgttgagaacttctgacaaggacatcaagttgaaattgatccaaatcttggaattcgataccaactctttggcttacaccaagaacttcatcaaccaattggttaacatgatcaagaatgacaacgaaaacaaatacttgccagacttggcttcccactccgataccgctaccaacttgcacgacgaattgttgtacattattgaccatttgtctgagtta

SEQ ID NO: 84 - protein, 335 aa, Saccharomyces cerevisiae [sequence omitted]

SEQ ID NO: 85 - DNA, 1575 bp, Gibberella fujikuroi
  CDS (1)..(1575)
atgtccaagtctaactccatgaactccacttctcacgaaactttattccaacaattggttttgggtttggacagaatgccattgatggatgtccactggttgatctacgttgctttcggtgcttggttatgttcctacgtcattcacgttttgtcctcttcttctaccgtcaaggttccagttgtcggttacagatccgttttcgaaccaacctggttattgagattaagatttgtctgggaaggtggttccattattggtcaaggttacaacaaattcaaggactctatcttccaagtcagaaagttgggtactgacattgttatcatcccaccaaactacatcgatgaagtcagaaagttgtcccaagacaagaccagatctgttgaaccattcatcaacgatttcgctggtcaatacaccagaggtatggtctttctacaatctgatttgcaaaaccgtgtcatccaacaaagattgactccaaagttggtttctttgactaaggtcatgaaggaagaattggactacgctttgaccaaggaaatgccagacatgaagaacgacgaatgggttgaagttgacatttcttccatcatggtcagattgatctccagaatctctgcccgtgttttcttgggtccagaacactgtcgtaaccaagaatggttgaccaccactgctgaatactctgaatctttattcatcactggtttcatcttgagagttgtcccacacatcttaagaccattcattgctccattgttgccttcttacagaactttgttgagaaatgtctcttctggtagaagagttatcggtgatatcatcagatctcaacaaggtgatggtaacgaagatatcttgtcctggatgagagatgctgctaccggtgaagaaaagcaaattgacaacattgctcaaagaatgttgatcttgtctttggcttccattcacaccaccgccatgaccatgacccatgccatgtacgacttgtgtgcctgtccagaatacattgaaccattacgtgacgaagtcaaatccgttgttggtgcttctggttgggacaagactgctttgaacagattccacaagttggactctttcttgaaggaatctcaaagattcaacccagttttcttgttgactttcaacagaatctaccatcaatccatgactttgtccgatggtaccaacattccatctggtaccagaattgctgttccatctcacgctatgttgcaagattctgctcacgttccaggtccaactcctccaactgaatttgacggtttcagatactccaagatcagatctgactctaactatgctcaaaagtacttgttctccatgaccgattcttccaacatggctttcggttacggtaagtacgcttgtccaggtcgtttctacgcctccaacgaaatgaaattgactttggccattttgttgttgcaatttgaattcaaattgccagatggtaagggtagaccaagaaacatcactatcgactctgacatgattccagacccaagagctagattatgtgtcagaaagagatctctacgtgacgaa

SEQ ID NO: 86 - protein, 525 aa, Gibberella fujikuroi
MSKSNSMNSTSHETLFQQLVLGLDRMPLMDVHWLIYVAFGAWLCSYVIHVLSSSSTVKVPVVGYRSVFEPTWLLRLRFVWEGGSIIGQGYNKFKDSIFQVRKLGTDIVIIPPNYIDEVRKLSQDKTRSVEPFINDFAGQYTRGMVFLQSDLQNRVIQQRLTPKLVSLTKVMKEELDYALTKEMPDMKNDEWVEVDISSIMVRLISRISARVFLGPEHCRNQEWLTTTAEYSESLFITGFILRVVPHILRPFIAPLLPSYRTLLRNVSSGRRVIGDIIRSQQGDGNEDILSWMRDAATGEEKQIDNIAQRMLILSLASIHTTAMTMTHAMYDLCACPEYIEPLRDEVKSVVGASGWDKTALNRFHKLDSFLKESQRFNPVFLLTFNRIYHQSMTLSDGTNIPSGTRIAVPSHAMLQDSAHVPGPTPPTEFDGFRYSKIRSDSNYAQKYLFSMTDSSNMAFGYGKYACPGRFYASNEMKLTLAILLLQFEFKLPDGKGRPRNITIDSDMIPDPRARLCVRKRSLRDE

SEQ ID NO: 87 - DNA, 1419 bp, Stevia rebaudiana
  CDS (1)..(1419)
atggccacttctgactccatcgttgatgacagaaagcaattgcacgttgctactttcccatggttagctttcggtcacattttgccatacttgcaattgtccaaattgattgctgaaaagggtcacaaagtctctttcttgtccaccaccagaaacatccaaagattatcttctcacatttctccattgatcaacgttgtccaattgactttaccaagagttcaagaattgccagaagatgctgaagctaccaccgatgtccatccagaagatatcccatacttgaagaaggcttctgatggtttgcaaccagaagtcactagattcttggaacaacactctccagactggattatctacgactacactcactactggttaccatccattgctgcctctttgggtatctctcgtgctcatttctccgttaccactccatgggctattgcttacatgggtccatctgctgatgctatgatcaacggttctgatggtagaaccactgtcgaagacttgaccactccaccaaaatggttcccattcccaaccaaggtctgttggagaaagcacgatttggccagattagttccatacaaggccccaggtatctctgacggttacagaatgggtttagtcttgaagggttctgactgtttgttgtccaagtgttaccatgaattcggtactcaatggttacctttgttggaaactttgcaccaagtcccagttgttccagttggtttgttgcctcctgaaatcccaggtgacgaaaaggacgaaacctgggtttccatcaagaaatggttagatggtaagcaaaagggttccgttgtctacgttgctttgggttctgaagtcttggtttctcaaactgaagttgttgaattggctttgggtttggaattgtccggtctaccatttgtctgggcttacagaaagccaaagggtccagctaagtctgactctgttgaattgccagatggtttcgtcgaaagaaccagagacagaggtttggtctggacttcctgggctccacaattgagaattttgtcccacgaatctgtttgtggtttcttgacccactgtggttctggttccattgtcgaaggtttgatgttcggtcacccattgatcatgttgccaatcttcggtgaccaaccattgaacgctagattattggaagacaagcaagtcggtattgaaatcccaagaaacgaagaagacggttgtttgaccaaggaatctgttgcccgttctctaagatctgttgttgtcgaaaaggaaggtgaaatctacaaggctaacgctagagaattgtccaagatctacaacgataccaaggtcgaaaaggaatatgtctcccaatttgttgactacttggaaaagaacgctcgtgccgttgccattgaccacgaaagc

SEQ ID NO: 88 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEIPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNARAVAIDHES

SEQ ID NO: 89 - DNA, 1575 bp, Stevia rebaudiana
  CDS (1)..(1575)
atgggtttgttcccattagaggattcctacgcgctggtctttgaaggactagcaataacactggctttgtactatctactgtctttcatctacaaaacatctaaaaagacatgtacacctcctaaagcatctggtgaaatcattccaattacaggaatcatattgaatctgctatctggctcaagtggtctacctattatcttagcacttgcctctttagcagacagatgtggtcctattttcaccattaggctgggtattaggagagtgctagtagtatcaaattgggaaatcgctaaggagattttcactacccacgatttgatagtttctaatagaccaaaatacttagccgctaagattcttggtttcaattatgtttcattctctttcgctccatacggcccatattgggtcggaatcagaaagattattgctacaaaactaatgtcttcttccagacttcagaagttgcaatttgtaagagtttttgaactagaaaactctatgaaatctatcagagaatcatggaaggagaaaaaggatgaagagggaaaggtattagttgagatgaaaaagtggttctgggaactgaatatgaacatagtgttaaggacagttgctggtaaacaatacactggtacagttgatgatgccgatgcaaagcgtatctccgagttattcagagaatggtttcactacactggcagatttgtcgttggagatgcttttccttttctaggttggttggacctgggcggatacaaaaagacaatggaattagttgctagtagattggactcaatggtcagtaaatggttagatgagcatcgtaaaaagcaagctaacgatgacaaaaaggaggatatggatttcatggatatcatgatctccatgacagaagcaaattcaccacttgaaggatacggcactgatactattatcaagaccacatgtatgactttgattgtttcaggagttgatacaacctcaatcgtacttacttgggccttatcacttttgttaaacaacagagatactttgaaaaaggcacaagaggaattagatatgtgcgtaggtaaaggaagacaagtcaacgagtctgatcttgttaacttgatatacttggaagcagtgcttaaagaggctttaagactttacccagcagcgttcttaggcggaccaagagcattcttggaagattgtactgttgctggttatagaattccaaagggcacctgcttgttgattaacatgtggaaactgcatagagatccaaacatttggagtgatccttgcgaattcaagccagaaagatttttgacacctaatcaaaaggatgttgatgtgatcggtatggatttcgaattgataccatttggtgccggcagaagatattgtccaggtactagattggctttacagatgttgcatatcgtattagcgacattgctgcaaaacttcgaaatgtcaacaccaaacgatgcgccagtcgatatgactgcttctgttggcatgacaaatgccaaagcatcacctttagaagtcttgctatcacctcgtgttaaatggtcc

SEQ ID NO: 90 - protein, 525 aa, Stevia rebaudiana
MGLFPLEDSYALVFEGLAITLALYYLLSFIYKTSKKTCTPPKASGEIIPITGIILNLLSGSSGLPIILALASLADRCGPIFTIRLGIRRVLVVSNWEIAKEIFTTHDLIVSNRPKYLAAKILGFNYVSFSFAPYGPYWVGIRKIIATKLMSSSRLQKLQFVRVFELENSMKSIRESWKEKKDEEGKVLVEMKKWFWELNMNIVLRTVAGKQYTGTVDDADAKRISELFREWFHYTGRFVVGDAFPFLGWLDLGGYKKTMELVASRLDSMVSKWLDEHRKKQANDDKKEDMDFMDIMISMTEANSPLEGYGTDTIIKTTCMTLIVSGVDTTSIVLTWALSLLLNNRDTLKKAQEELDMCVGKGRQVNESDLVNLIYLEAVLKEALRLYPAAFLGGPRAFLEDCTVAGYRIPKGTCLLINMWKLHRDPNIWSDPCEFKPERFLTPNQKDVDVIGMDFELIPFGAGRRYCPGTRLALQMLHIVLATLLQNFEMSTPNDAPVDMTASVGMTNAKASPLEVLLSPRVKWS

SEQ ID NO: 91 - DNA, 1428 bp, Stevia rebaudiana
  CDS (1)..(1428)
atgatacaagttttaactccaattctactcttcctcatcttcttcgttttctggaaagtctacaaacatcaaaagactaaaatcaatctaccaccaggttccttcggctggccatttttgggtgaaaccttagccttacttagagcaggctgggattctgagccagaaagattcgtaagagagcgtatcaaaaagcatggatctccacttgttttcaagacatcactatttggagacagattcgctgttctttgcggtccagctggtaataagtttttgttctgcaacgaaaacaaattagtggcatcttggtggccagtccctgtaaggaagttgttcggtaaaagtttactcacaataagaggagatgaagcaaaatggatgagaaaaatgctattgtcttacttgggtccagatgcatttgccacacattatgccgttactatggatgttgtaacacgtagacatattgatgtccattggaggggcaaggaggaagttaatgtatttcaaacagttaagttgtacgcattcgaattagcttgtagattattcatgaacctagatgacccaaaccacatcgcgaaactcggtagtcttttcaacattttcctcaaagggatcatcgagcttcctatagacgttcctggaactagattttactccagtaaaaaggccgcagctgccattagaattgaattgaaaaagctcattaaagctagaaaactcgaattgaaggagggtaaggcgtcttcttcacaggacttgctttctcatctattaacatcacctgatgagaatgggatgttcttgacagaagaggaaatagtcgataacattctacttttgttattcgctggtcacgatacctctgcactatcaataacacttttgatgaaaaccttaggtgaacacagtgatgtgtacgacaaggttttgaaggaacaattagaaatttccaaaacaaaggaggcttgggaatcactaaagtgggaagatatccagaagatgaagtactcatggtcagtaatctgtgaagtcatgagattgaatcctcctgtcatagggacatacagagaggcgttggttgatatcgactatgctggttacactatcccaaaaggatggaagttgcattggtcagctgtttctactcaaagagatgaagccaatttcgaagatgtaactagattcgatccatccagatttgaaggggcaggccctactccattcacatttgtgcctttcggtggaggtcctagaatgtgtttaggcaaagagtttgccaggttagaagtgttagcatttctccacaacattgttaccaactttaagtgggatcttctaatccctgatgagaagatcgaatatgatccaatggctactccagctaagggcttgccaattagacttcatccacaccaagtc

SEQ ID NO: 92 - protein, 476 aa, Stevia rebaudiana; identical to SEQ ID NO: 32

SEQ ID NO: 93 - DNA, 1575 bp, Arabidopsis thaliana
  CDS (1)..(1575)
atggagtctttagtggttcatacagtaaatgctatctggtgtattgtaatcgtcgggattttctcagttggttatcacgtttacggtagagctgtggtcgaacaatggagaatgagaagatcactgaagctacaaggtgttaaaggcccaccaccatccatcttcaatggtaacgtttcagaaatgcaacgtatccaatccgaagctaaacactgctctggcgataacattatctcacatgattattcttcttcattattcccacacttcgatcactggagaaaacagtacggcagaatctacacatactctactggattaaagcaacacttgtacatcaatcatccagaaatggtgaaggagctatctcagactaacacattgaacttgggtagaatcacccatataaccaaaagattgaatcctatcttaggtaacggaatcataacctctaatggtcctcattgggcccatcagcgtagaattatcgcctacgagtttactcatgataagatcaagggtatggttggtttgatggttgagtctgctatgcctatgttgaataagtgggaggagatggtaaagagaggcggagaaatgggatgcgacataagagttgatgaggacttgaaagatgtttcagcagatgtgattgcaaaagcctgtttcggatcctcattttctaaaggtaaggctattttctctatgataagagatttgcttacagctatcacaaagagaagtgttctattcagattcaacggattcactgatatggtctttgggagtaaaaagcatggtgacgttgatatagacgctttagaaatggaattggaatcatccatttgggaaactgtcaaggaacgtgaaatagaatgtaaagatactcacaaaaaggatctgatgcaattgattttggaaggggcaatgcgttcatgtgacggtaacctttgggataaatcagcatatagaagatttgttgtagataattgtaaatctatctacttcgcagggcatgatagtacagctgtctcagtgtcatggtgtttgatgttactggccctaaacccatcatggcaagttaagatccgtgatgaaattctgtcttcttgcaaaaatggtattccagatgccgaaagtatcccaaaccttaaaacagtgactatggttattcaagagacaatgagattataccctccagcaccaatcgtcgggagagaagcctctaaagatatcagattgggcgatctagttgttcctaaaggcgtctgtatatggacactaataccagctttacacagagatcctgagatttggggaccagatgcaaacgatttcaaaccagaaagattttctgaaggaatttcaaaggcttgtaagtatcctcaaagttacattccatttggtctgggtcctagaacatgcgttggtaaaaactttggcatgatggaagtaaaggttcttgtttccctgattgtctccaagttctctttcactctatctcctacctaccaacatagtcctagtcacaaacttttagtagaaccacaacatggggtggtaattagagtggtt

SEQ ID NO: 94 - protein, 525 aa, Arabidopsis thaliana; identical to SEQ ID NO: 34

SEQ ID NO: 95 - DNA, 1587 bp, Vitis vinifera
  CDS (1)..(1587)
atgtacttcctactacaatacctcaacatcacaaccgttggtgtctttgccacattgtttctctcttattgtttacttctctggagaagtagagcgggtaacaaaaagattgccccagaagctgccgctgcatggcctattatcggccacctccacttacttgcaggtggatcccatcaactaccacatattacattgggtaacatggcagataagtacggtcctgtattcacaatcagaataggcttgcatagagctgtagttgtctcatcttgggaaatggcaaaggaatgttcaacagctaatgatcaagtgtcttcttcaagacctgaactattagcttctaagttgttgggttataactacgccatgtttggtttttcaccatacggttcatactggagagaaatgagaaagatcatctctctcgaattactatctaattccagattggaactattgaaagatgttagagcctcagaagttgtcacatctattaaggaactatacaaattgtgggcggaaaagaagaatgagtcaggattggtttctgtcgagatgaaacaatggttcggagatttgactttaaacgtgatcttgagaatggtggctggtaaaagatacttctccgcgagtgacgcttcagaaaacaaacaggcccagcgttgtagaagagtcttcagagaattcttccatctctccggcttgtttgtggttgctgatgctataccttttcttggatggctcgattggggaagacacgagaagaccttgaaaaagaccgccatagaaatggattccatcgcccaggagtggcttgaggaacatagacgtagaaaagattctggagatgataattctacccaagatttcatggacgttatgcaatctgtgctagatggcaaaaatctaggcggatacgatgctgatacgattaacaaggctacatgcttaactcttatatcaggtggcagtgatactactgtagtttctttgacatgggctcttagtcttgtgttaaacaatagagatactttgaaaaaggcacaggaagagttagacatccaagtcggtaaggaaagattggttaacgagcaagacatcagtaagttagtttacttgcaagcaatagtaaaagagacactcagactttatccaccaggtcctttgggtggtttgagacaattcactgaagattgtacactaggtggctatcacgtttcaaaaggaactagattaatcatgaacttatccaagattcaaaaagatccacgtatttggtctgatcctactgaattccaaccagagagattccttacgactcataaagatgtcgatccacgtggtaaacactttgaattcattccattcggtgcaggaagacgtgcatgtcctggtatcacattcggattacaagtactacatctaacattggcatctttcttgcatgcgtttgaattttcaacaccatcaaatgagcaggttaacatgagagaatcattaggtcttacgaatatgaaatctaccccattagaagttttgatttctccaagactatcccttaattgcttcaaccttatgaaaatt

SEQ ID NO: 96 - protein, 529 aa, Vitis vinifera
MYFLLQYLNITTVGVFATLFLSYCLLLWRSRAGNKKIAPEAAAAWPIIGHLHLLAGGSHQLPHITLGNMADKYGPVFTIRIGLHRAVVVSSWEMAKECSTANDQVSSSRPELLASKLLGYNYAMFGFSPYGSYWREMRKIISLELLSNSRLELLKDVRASEVVTSIKELYKLWAEKKNESGLVSVEMKQWFGDLTLNVILRMVAGKRYFSASDASENKQAQRCRRVFREFFHLSGLFVVADAIPFLGWLDWGRHEKTLKKTAIEMDSIAQEWLEEHRRRKDSGDDNSTQDFMDVMQSVLDGKNLGGYDADTINKATCLTLISGGSDTTVVSLTWALSLVLNNRDTLKKAQEELDIQVGKERLVNEQDISKLVYLQAIVKETLRLYPPGPLGGLRQFTEDCTLGGYHVSKGTRLIMNLSKIQKDPRIWSDPTEFQPERFLTTHKDVDPRGKHFEFIPFGAGRRACPGITFGLQVLHLTLASFLHAFEFSTPSNEQVNMRESLGLTNMKSTPLEVLISPRLSLNCFNLMKI

SEQ ID NO: 97 - DNA, 1437 bp, Medicago truncatula
  CDS (1)..(1437)
atggaacctaacttttacttgtcattactattgttgttcgtgaccttcatttctttaagtctgtttttcatcttttacaaacaaaagtccccattgaatttgccaccagggaaaatgggttaccctatcataggtgaaagtttagaattcctatccacaggctggaagggacatcctgaaaagttcatatttgatagaatgcgtaagtacagtagtgagttattcaagacttctattgtaggcgaatccacagttgtttgctgtggggcagctagtaacaaattcctattctctaacgaaaacaaactggtaactgcctggtggccagattctgttaacaaaatcttcccaacaacttcactggattctaatttgaaggaggaatctataaagatgagaaagttgctgccacagttcttcaaaccagaagcacttcaaagatacgtcggcgttatggatgtaatcgcacaaagacattttgtcactcactgggacaacaaaaatgagatcacagtttatccacttgctaaaagatacactttcttgcttgcgtgtagactgttcatgtctgttgaggatgaaaatcatgtggcgaaattctcagacccattccaactaatcgctgcaggcatcatttcacttcctatcgatcttcctggtactccattcaacaaggccataaaggcttcaaatttcattagaaaagagctgataaagattatcaaacaaagacgtgttgatctggcagagggtacagcatctccaacccaggatatcttgtcacatatgctattaacatctgatgaaaacggtaaatctatgaacgagttgaacattgccgacaagattcttggactattgataggaggccacgatacagcttcagtagcttgcacatttctagtgaagtacttaggagaattaccacatatctacgataaagtctaccaagagcaaatggaaattgccaagtccaaacctgctggggaattgttgaattgggatgacttgaaaaagatgaagtattcatggaatgtggcatgtgaggtaatgagattgtcaccacctttacaaggtggttttagagaggctataactgactttatgtttaacggtttctctattccaaaagggtggaagttatactggtccgccaactctacacacaaaaatgcagaatgtttcccaatgcctgagaaattcgatcctaccagatttgaaggtaatggtccagcgccttatacatttgtaccattcggtggaggccctagaatgtgtcctggaaaggaatacgctagattagaaatcttggttttcatgcataatctggtcaaacgttttaagtgggaaaaggttattccagacgaaaagattattgtcgatccattcccaatcccagctaaagatcttccaatccgtttgtatcctcacaaagct

SEQ ID NO: 98 - protein, 479 aa, Medicago truncatula
MEPNFYLSLLLLFVTFISLSLFFIFYKQKSPLNLPPGKMGYPIIGESLEFLSTGWKGHPEKFIFDRMRKYSSELFKTSIVGESTVVCCGAASNKFLFSNENKLVTAWWPDSVNKIFPTTSLDSNLKEESIKMRKLLPQFFKPEALQRYVGVMDVIAQRHFVTHWDNKNEITVYPLAKRYTFLLACRLFMSVEDENHVAKFSDPFQLIAAGIISLPIDLPGTPFNKAIKASNFIRKELIKIIKQRRVDLAEGTASPTQDILSHMLLTSDENGKSMNELNIADKILGLLIGGHDTASVACTFLVKYLGELPHIYDKVYQEQMEIAKSKPAGELLNWDDLKKMKYSWNVACEVMRLSPPLQGGFREAITDFMFNGFSIPKGWKLYWSANSTHKNAECFPMPEKFDPTRFEGNGPAPYTFVPFGGGPRMCPGKEYARLEILVFMHNLVKRFKWEKVIPDEKIIVDPFPIPAKDLPIRLYPHKA

SEQ ID NO: 99 - DNA, 1419 bp, Stevia rebaudiana
  CDS (1)..(1419)
atggctacatctgattctattgttgatgacaggaagcagttgcatgtggctactttcccttggcttgctttcggtcatatactgccttacctacaactatcaaaactgatagctgaaaaaggacataaagtgtcattcctttcaacaactagaaacattcaaagattatcttcccacatatcaccattgattaacgtcgttcaattgacacttccaagagtacaggaattaccagaagatgctgaagctacaacagatgtgcatcctgaagatatcccttacttgaaaaaggcatccgatggattacagcctgaggtcactagattccttgagcaacacagtccagattggatcatatacgactacactcactattggttgccttcaattgcagcatcactaggcatttctagggcacatttcagtgtaaccacaccttgggccattgcttacatgggtccatccgctgatgctatgattaacggcagtgatggtagaactaccgttgaagatttgacaaccccaccaaagtggtttccatttccaactaaagtctgttggagaaaacacgacttagcaagactggttccatacaaggcaccaggaatctcagacggctatagaatgggtttagtccttaaagggtctgactgcctattgtctaagtgttaccatgagtttgggacacaatggctaccacttttggaaacattacaccaagttcctgtcgtaccagttggtctattacctccagaaatccctggtgatgagaaggacgagacttgggtttcaatcaaaaagtggttagacgggaagcaaaaaggctcagtggtatatgtggcactgggttccgaagttttagtatctcaaacagaagttgtggaacttgccttaggtttggaactatctggattgccatttgtctgggcctacagaaaaccaaaaggccctgcaaagtccgattcagttgaattgccagacggctttgtcgagagaactagagatagagggttggtatggacttcatgggctccacaattgagaatcctgagtcacgaatctgtgtgcggtttcctaacacattgtggttctggttctatagttgaaggactgatgtttggtcatccacttatcatgttgccaatctttggtgaccagcctttgaatgcacgtctgttagaagataaacaagttggaattgaaatcccacgtaatgaggaagatggatgtttaaccaaggagtctgtggccagatcattacgttccgttgtcgttgaaaaggaaggcgaaatctacaaggccaatgcccgtgaactttcaaagatctacaatgacacaaaagtagagaaggaatatgtttctcaatttgtagattacctagagaaaaacgctagagccgtagctattgatcatgaatcc

SEQ ID NO: 100 - protein, 473 aa, Stevia rebaudiana; identical to SEQ ID NO: 88

SEQ ID NO: 101 - DNA, 1377 bp, Ipomoea purpurea
  CDS (1)..(1377)
atgggttctcaagctaccacctaccacatggccatgtacccatggttcggtgtcggtcatttgactggtttcttcagattggctaacaagttggctggtaagggtcacagaatctctttcttgattccaaagaacactcaatccaaattggaatctttcaacttgcacccacatttgatctctttcgttccaattgttgttccatccattccaggtctaccaccaggtgctgaaaccacctctgatgtcccattcccatctacccatttgttgatggaagctatggacaagactcaaaacgatattgaaatcatcttgaaggacttgaaggtcgatgtcgttttctacgatttcacccactggttaccatctttggccagaaagatcggtatcaaatccgtcttttactccaccatttctccattgatgcacggttacgctttgtccccagaaagaagagttgtcggtaagcaattgactgaagctgacatgatgaaggctccagcttctttcccagacccatccatcaaattgcacgctcacgaagccagaggtttcaccgccagaaccgttatgaagttcggtggtgatatcactttcttcgatcgtattttcactgctgtttctgaatctgatggtttggcttactccacttgtcgtgaaatcgaaggtcaattctgtgactacattgaaactcaattccaaaagccagtcttattggctggtccagctttgccagttccttccaagtccaccatggaacaaaaatggtctgactggttaggtaagttcaaggaaggttctgtcatttactgtgctttcggttctgaatgtaccttgagaaaggacaaattccaagaactattatggggtttggaattgactggtatgccattctttgctgctttgaagcctccatttgaaactgaatctgttgaagctgccatcccagaagaattgaaggaaaagatccaaggtagaggtatcgttcacggtgaatgggttcaacaacaattgtttttgcaacacccatctgttggttgtttcgtttcccactgtggttgggcttctttgtccgaagctttggtcaatgactgtcaaatcgtcttgttgccacaagtcggtgaccaaattattaacgccagaatcatgtccgtttctttgaaggttggtgttgaagtcgaaaagggtgaagaagatggtgttttctccagagaatctgtctgtaaggccgtcaaggctgtcatggatgaaaagtctgaaatcggtagagaagttagaggtaaccacgacaaattgagaggtttcttgatgaacgctgacttggactccaagtacatggactctttcaaccaaaagttgcaagacttattaggg

SEQ ID NO: 102 - protein, 459 aa, Ipomoea purpurea
MGSQATTYHMAMYPWFGVGHLTGFFRLANKLAGKGHRISFLIPKNTQSKLESFNLHPHLISFVPIVVPSIPGLPPGAETTSDVPFPSTHLLMEAMDKTQNDIEIILKDLKVDVVFYDFTHWLPSLARKIGIKSVFYSTISPLMHGYALSPERRVVGKQLTEADMMKAPASFPDPSIKLHAHEARGFTARTVMKFGGDITFFDRIFTAVSESDGLAYSTCREIEGQFCDYIETQFQKPVLLAGPALPVPSKSTMEQKWSDWLGKFKEGSVIYCAFGSECTLRKDKFQELLWGLELTGMPFFAALKPPFETESVEAAIPEELKEKIQGRGIVHGEWVQQQLFLQHPSVGCFVSHCGWASLSEALVNDCQIVLLPQVGDQIINARIMSVSLKVGVEVEKGEEDGVFSRESVCKAVKAVMDEKSEIGREVRGNHDKLRGFLMNADLDSKYMDSFNQKLQDLLG

SEQ ID NO: 103 - DNA, 1314 bp, Bellis perennis
  CDS (1)..(1314)
atggactctaagattgactccaagactttcagagttgttatgttgccatggttggcttactcccacatctcttctttcttggttttcgctaagagattgaccaaccacaacttccacatctacatctgttcctctcaaaccaacatgcaatacttgaagaacaacttgacttctcaatactccaagtccatccaattgattgaattgaacttgccatcttcttctgaattgccattgcaataccacaccacccacggtctaccacctcatttgaccaagactctatccgatgactaccaaaaatctggtccagacttcgaaaccatcttgatcaaattgaaccctcacttagtcatctacgacttcaaccaattatgggctccagaagttgcttccactttgcacattccatctatccaattgttgtccggttgtgttgctttgtacgctttggatgctcatttgtacaccaagccattggatgaaaacttggccaagttcccattcccagaaatctacccaaagaacagagatatcccaaagggtggttccaaatacatcgaaagatttgtcgactgtatgagaagatcttgtgaaatcatcttggtcagatccactatggaattggaaggtaagtacattgactacttgtctaagactttaggtaagaaggtcttaccagttggtccattagtccaagaagcttctttgttgcaagatgaccacatctggatcatgaaatggttggacaagaaggaagaatcctctgttgtctttgtttgtttcggttctgaatacattttgtctgacaacgaaatcgaagacattgcttacggtttggaattgtctcaagtctctttcgtctgggctatcagagccaagacctctgctttgaatggtttcattgaccgtgttggtgacaagggtttggtcattgacaaatgggttccacaagctaacatcttgtcccactcttccactggtggtttcatctcccactgtggttggtcctctaccatggaatccatcagatacggtgttccaatcattgctatgccaatgcaattcgatcaaccatacaacgccagattgatggaaactgtcggtgctggtattgaagttggtagagatggtgaaggtagattgaagcgtgaagaaattgccgctgttgtcagaaaggttgttgttgaagattctggtgaatctatcagagaaaaggccaaggaattaggtgaaattatgaagaagaacatggaagctgaagtcgatggtattgtcattgaaaacttagtcaaattgtgtgaaatgaacaac

SEQ ID NO: 104 - protein, 438 aa, Bellis perennis
MDSKIDSKTFRVVMLPWLAYSHISSFLVFAKRLTNHNFHIYICSSQTNMQYLKNNLTSQYSKSIQLIELNLPSSSELPLQYHTTHGLPPHLTKTLSDDYQKSGPDFETILIKLNPHLVIYDFNQLWAPEVASTLHIPSIQLLSGCVALYALDAHLYTKPLDENLAKFPFPEIYPKNRDIPKGGSKYIERFVDCMRRSCEIILVRSTMELEGKYIDYLSKTLGKKVLPVGPLVQEASLLQDDHIWIMKWLDKKEESSVVFVCFGSEYILSDNEIEDIAYGLELSQVSFVWAIRAKTSALNGFIDRVGDKGLVIDKWVPQANILSHSSTGGFISHCGWSSTMESIRYGVPIIAMPMQFDQPYNARLMETVGAGIEVGRDGEGRLKREEIAAVVRKVVVEDSGESIREKAKELGEIMKKNMEAEVDGIVIENLVKLCEMNN

SEQ ID NO: 105 - DNA, 1419 bp, Stevia rebaudiana
  CDS (1)..(1419)
atggccacttctgactctattgtcgatgacagaaagcaattgcacgttgccactttcccatggttggccttcggtcacattttgccatacttgcaattgtccaagttgattgctgaaaagggtcacaaggtttctttcttgtccactaccagaaacatccaaagattatcttctcacatctctccattaatcaacgttgtccaattgactttaccaagagttcaagaattgccagaagatgctgaagctaccaccgatgtccatccagaagatatcccatacttgaagaaggcttctgacggtttgcaacctgaagtcacccgtttcttggaacaacactctccagactggatcatctacgactacactcactactggttaccttccattgctgcttctttgggtatctcccgtgctcatttctccgtcaccactccatgggctattgcttacatgggtccatctgctgatgctatgatcaacggttctgatggtagaaccactgttgaagatttgaccactccaccaaaatggttcccattcccaactaaggtctgttggagaaagcacgatttggccagattggttccatacaaggctccaggtatctctgatggttacagaatgggtttggttttgaaaggttctgactgtttgttgtccaaatgttaccatgaattcggtactcaatggttaccattgttggaaactttgcaccaagttccagttgttccagtcggtctattaccaccagaagtcccaggtgacgaaaaggacgaaacctgggtttccatcaagaaatggttagatggtaagcaaaagggttccgttgtctacgttgctttgggttctgaagtcttggtttctcaaactgaagttgtcgaattggctttaggtttggaattgtccggtttgcctttcgtctgggcttacagaaagccaaagggtccagctaaatctgactccgtcgaattaccagacggtttcgttgaaagaacccgtgacagaggtttggtctggacttcctgggctccacaattgagaatcttgtcccacgaatctgtttgtggtttcttgacccactgtggttctggttccattgtcgaaggtttgatgtttggtcacccattgatcatgttgccaatcttcggtgaccaaccattgaacgccagattattggaagacaagcaagtcggtattgaaattccaagaaacgaagaagatggttgtttgaccaaggaatctgttgccagatctttgagatccgttgttgtcgaaaaggaaggtgaaatctacaaggctaacgctagagaattgtctaagatctacaacgacaccaaggttgaaaaggaatacgtttctcaatttgtcgactacttggaaaagaacaccagagctgttgccattgaccacgaaagt

SEQ ID NO: 106 - protein, 473 aa, Stevia rebaudiana
MATSDSIVDDRKQLHVATFPWLAFGHILPYLQLSKLIAEKGHKVSFLSTTRNIQRLSSHISPLINVVQLTLPRVQELPEDAEATTDVHPEDIPYLKKASDGLQPEVTRFLEQHSPDWIIYDYTHYWLPSIAASLGISRAHFSVTTPWAIAYMGPSADAMINGSDGRTTVEDLTTPPKWFPFPTKVCWRKHDLARLVPYKAPGISDGYRMGLVLKGSDCLLSKCYHEFGTQWLPLLETLHQVPVVPVGLLPPEVPGDEKDETWVSIKKWLDGKQKGSVVYVALGSEVLVSQTEVVELALGLELSGLPFVWAYRKPKGPAKSDSVELPDGFVERTRDRGLVWTSWAPQLRILSHESVCGFLTHCGSGSIVEGLMFGHPLIMLPIFGDQPLNARLLEDKQVGIEIPRNEEDGCLTKESVARSLRSVVVEKEGEIYKANARELSKIYNDTKVEKEYVSQFVDYLEKNTRAVAIDHES

SEQ ID NO: 107 - DNA, 1455 bp, Stevia rebaudiana
  CDS (1)..(1455)
atgtacaacgtcacctaccatcaaaactccaaggctatggctacttctgactctattgtcgatgacagaaagcaattgcacgttgccactttcccatggttagctttcggtcacatcttaccattcttgcaattgtccaaattgattgctgaaaagggtcacaaggtttctttcttgtctaccactagaaacattcaaagattgtcttcccacatctctccattgatcaacgttgttcaattgactctaccaagagtccaagaattaccagaagatgctgaagctaccaccgatgtccatccagaagatatccaatacttgaagaaggctgttgacggtttgcaaccagaagttaccagattcttggaacaacactctccagactggatcatctacgacttcacccactactggttaccttccattgctgcctccttgggtatctccagagcttacttctgtgttatcactccatggaccattgcttacttggctccatcttctgatgctatgatcaacgactctgacggtagaaccactgtcgaagatttgaccactccacctaaatggttcccattcccaactaaggtctgttggagaaagcatgacttggccagaatggaaccatacgaagctccaggtatctccgatggttacagaatgggtatggttttcaagggttctgactgtttgttgttcaagtgttaccacgaattcggtactcaatggttaccattgttggaaactttgcaccaagtcccagttgtcccagtcggtttgttgccaccagaaatcccaggtgacgaaaaggacgaaacctgggtttccatcaagaaatggttggatggtaagcaaaagggttccgttgtctacgttgccttgggttctgaagctttagtctctcaaactgaagttgttgaattggctttgggtttggaattgtctggtctaccatttgtctgggcttacagaaagccaaagggtccagccaaatctgactccgttgaattgccagatggtttcgtcgaacgtaccagagacagaggtttagtctggacttcctgggctcctcaattgagaatcttgtctcacgaatctgtctgtggtttcttgactcactgtggttctggttccattgtcgaaggtttgatgttcggtcacccattgattatgttgccaattttctgtgaccaaccattgaacgctagattattggaagacaaacaagtcggtattgaaatcccaagaaacgaagaagatggttgtttgaccaaggaatctgttgctcgttctttgagatctgttgttgtcgaaaacgaaggtgaaatctacaaggccaatgctcgtgctttgtccaagatctacaacgataccaaggttgaaaaggaatacgtttctcaatttgttgactacttggaaaagaacgccagagctgttgccattgaccacgaatcc

SEQ ID NO: 108 - protein, 485 aa, Stevia rebaudiana
MYNVTYHQNSKAMATSDSIVDDRKQLHVATFPWLAFGHILPFLQLSKLIAEKGHKVSFLSTTRNIQRLSSHISPLINVVQLTLPRVQELPEDAEATTDVHPEDIQYLKKAVDGLQPEVTRFLEQHSPDWIIYDFTHYWLPSIAASLGISRAYFCVITPWTIAYLAPSSDAMINDSDGRTTVEDLTTPPKWFPFPTKVCWRKHDLARMEPYEAPGISDGYRMGMVFKGSDCLLFKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPIFCDQPLNARLLEDKQVGIEIPRNEEDGCLTKESVARSLRSVVVENEGEIYKANARALSKIYNDTKVEKEYVSQFVDYLEKNARAVAIDHES

SEQ ID NO: 109 - DNA, 1419 bp, Stevia rebaudiana
  CDS (1)..(1419)
atggccacttctgactccattgttgatgacagaaagcaattgcacgttgctactttcccatggttggcctttggtcacattttgcctttcttgcaattgtctaaattgattgctgaaaagggtcacaaggtttccttcttgtctaccaccagaaacatccaaagattatcttcccacatctctcctttgatcaacgttgttcaattgactctaccacgtgtccaagaattaccagaagacgctgaagctactaccgatgtccacccagaagatatccaatacttgaagaaggctgtcgatggtttgcaaccagaagtcaccagattcttggaacaacactctccagactggatcatctacgacttcactcactactggttgccatccattgctgcttctttgggtatctccagagcttacttctgtgtcatcactccatggaccattgcttacttggctccatcttctgatgctatgattaacgattctgatggtagaaccaccgtcgaagacttgaccactccaccaaaatggttcccattcccaaccaaggtctgttggagaaagcacgacttggccagaatggaaccatacgaagctccaggtatctccgatggttacagaatgggtatggttttcaagggttccgactgtctattattcaaatgttaccatgaatttggtactcaatggttaccattgttggaaactttgcaccaagtcccagttgttccagttggtttgttgcctccagaaatcccaggtgatgaaaaggacgaaacctgggtttccatcaagaaatggttggacggtaagcaaaagggttctgttgtctacgttgctttgggttctgaagctttggtttctcaaactgaagttgtcgaattggctttaggtttggaattgtccggtttgccattcgtctgggcttacagaaagccaaagggtccagctaagtctgactctgttgaattgccagatggtttcgttgaaagaaccagagacagaggtttggtctggacttcttgggctccacaattgagaattttgtcccacgaatctgtctgtggtttcttgactcactgtggttctggttccattgtcgaaggtttgatgttcggtcatccattgatcatgttgccattattcggtgaccaaccattgaacgctagattattggaagacaaacaagtcggtattgaaattccaagaaacgaagaagatggttgtttgaccaaggaatccgttgctcgttctttacgttctgtcgttgtcgaaaacgaaggtgaaatctacaaggccaatgccagagaattgtccaagatctacaacgacaccaaggttgaaaaggaatacgtttctcaatttgtcgactacttggaaaagaacgccagagctgttgccatcgaccacgaatcc

SEQ ID NO: 110 - protein, 473 aa, Stevia rebaudiana
MATSDSIVDDRKQLHVATFPWLAFGHILPFLQLSKLIAEKGHKVSFLSTTRNIQRLSSHISPLINVVQLTLPRVQELPEDAEATTDVHPEDIQYLKKAVDGLQPEVTRFLEQHSPDWIIYDFTHYWLPSIAASLGISRAYFCVITPWTIAYLAPSSDAMINDSDGRTTVEDLTTPPKWFPFPTKVCWRKHDLARMEPYEAPGISDGYRMGMVFKGSDCLLFKCYHEFGTQWLPLLETLHQVPVVPVGLLPPEIPGDEKDETWVSIKKWLDGKQKGSVVYVALGSEALVSQTEVVELALGLELSGLPFVWAYRKPKGPAKSDSVELPDGFVERTRDRGLVWTSWAPQLRILSHESVCGFLTHCGSGSIVEGLMFGHPLIMLPLFGDQPLNARLLEDKQVGIEIPRNEEDGCLTKESVARSLRSVVVENEGEIYKANARELSKIYNDTKVEKEYVSQFVDYLEKNARAVAIDHES

SEQ ID NO: 111 - DNA, 1356 bp, Populus trichocarpa
  CDS (1)..(1356)
atggacgaacctcacgaattgcacattgctatgttcccatggttggcctttggtcacatcattccattcttggaattagccaagttgattgctcaaagaggtcacaagatctctttcatctccactccaagaaacatccaaagattaccaaccatcccaccaaacttgaccccaagaatcaacttagtctctttggctttgccacacgttgaaaacttgccaaacaacgctgaagccactgctgacttgccattcgacaagatcccatacttgaagattgcttacgacagattgcaagactctttgttccatttcttgcactcttcttctccagactggatcatcttcgattttgcctcctactggttaccagaaattgctaccaaattgggtatctccggtgttttgttctccatcttcggtgcttggactttatctttcgctggtccatcttactctgccattttgaacggtgatgacccaagaaccgaaccacaacatttcaccgttccaccaaaatgggtcactttcccatccaaggttgctttccgtatccacgaagctaagagattcttggttcaaatcgaagctaactcttctggtgtcactgacatcttcagatggggttccgttttggctggttgtgatgtcattgccgtcagatcttgtttggaattggaagctgacttcttgagattggtcgaagatttgcactgtaagccagttatcccagtcggtctattaccacctccagctcaatgttctgaaggtggttccagagaaggtggtgtcgacgaaaaatgggttaccatttctgaatggttggacaagcaaactcaaggttccgttgtctacattgctttcggttctgaattgaccatcaaccaaaatgaaatcactgaattggctttgggtttagaattgtctggtttgccattcttctgggctttcagaaacagagatgactccgttagattgccagatggtttcgatgaaagagtcaagggtcgtggtgttgtctggacttcctgggctcctcaattgagaatcatggctcacgaatccgttggtggtttcttgactcactgtggttactcctctgttatcgaagctttgtccttcggtttggctttaatcatgttgccatttgccattgaccaaggtttgattgcccgtgttttcgaaggtaagaaggtcggtattgaagtcccaagagatgaacaagatggttccttcaccagaaactctgttgctgaatctctaagattggtcattgttgacaaggaaggttctgcttacagagaaaacgctaagcaacaaatggttactttgtttggtttgacctacaccatgacg

SEQ ID NO: 112 - protein, 452 aa, Populus trichocarpa
MDEPHELHIAMFPWLAFGHIIPFLELAKLIAQRGHKISFISTPRNIQRLPTIPPNLTPRINLVSLALPHVENLPNNAEATADLPFDKIPYLKIAYDRLQDSLFHFLHSSSPDWIIFDFASYWLPEIATKLGISGVLFSIFGAWTLSFAGPSYSAILNGDDPRTEPQHFTVPPKWVTFPSKVAFRIHEAKRFLVQIEANSSGVTDIFRWGSVLAGCDVIAVRSCLELEADFLRLVEDLHCKPVIPVGLLPPPAQCSEGGSREGGVDEKWVTISEWLDKQTQGSVVYIAFGSELTINQNEITELALGLELSGLPFFWAFRNRDDSVRLPDGFDERVKGRGVVWTSWAPQLRIMAHESVGGFLTHCGYSSVIEALSFGLALIMLPFAIDQGLIARVFEGKKVGIEVPRDEQDGSFTRNSVAESLRLVIVDKEGSAYRENAKQQMVTLFGLTYTMT

SEQ ID NO: 113 - DNA, 1362 bp, Stevia rebaudiana
  CDS (1)..(1362)
atgtccttgaaaggtaacgacaaggaattacatttggtcatgttcccattctttgctttcggtcacatcactccatttgtccaattgtccaacaagatctcctctttgtacccaggtgtcaagatcactttcttggctgcttctgcttctgtttccagaatcgaaaccatgttgaacccatctaccaacaccaaggtcattccattgactttgccaagagtcgatggtctaccagaaggtgttgaaaacactgctgacgcttctccagctaccattggtctattggttgttgccattgatttgatgcaacctcaaatcaagactttattggctaacttgaagccagacttcgttatcttcgacttcgtccactggtggttaccagaaattgcttctgaattgggtatcaagaccatctacttctccgtttacatggccaacattgtcatgccatccacttccaagttgaccggtaacaagccatctaccgtcgaagatatcaaggctttgcaacaatcttacggtattccagttaagactttcgaagccatctctttgatgaacgttttcaagtctttccacgactggatggacaaatgtatcaacggttgtaacttgatgttgatcaagtcttgtcgtgaaatggaaggttccagaattgacgatgtcaccaagcaatctaccagaccagttttcttgattggtccagttgttccagaacctcactctggtgaattggacgaaacctgggctaactggttgaacagattcccagctaagtctgtcatctactgttcctttggttctgaaactttcttgaccgatgaccaaatcagagaattggccttgggtttagaattgactggtttgccattcttcttggtcttgaacttcccagccaatgtcgacaaatctgctgaattgaagagaactttaccagatggtttcttggaaagagttaaggacaagggtattgtccactctggttgggttcaacaaagacacatcttggctcatgactctgttggttgttacgttttccacgctggttacggttccgttatcgaaggtttggtcaatgactgtcaattagtcatgttgccaatgaaggttgaccaattcaccaactccaaggttattgctttggaattgaaggctggtgttgaagttaacagaagagatgaagatggttacttcggtaaggacgatgtcttcgaagctgtcgaatctgtcatgatggacactgaaaacgaaccagccaagtccatcagagaaaaccaccgtaaattgaaggaatttttgcaaaacgatgaaatccaaaagaaatacattgctgatttcgttgaaaacttgaaagcgtta

SEQ ID NO: 114 - protein, 454 aa, Stevia rebaudiana
MSLKGNDKELHLVMFPFFAFGHITPFVQLSNKISSLYPGVKITFLAASASVSRIETMLNPSTNTKVIPLTLPRVDGLPEGVENTADASPATIGLLVVAIDLMQPQIKTLLANLKPDFVIFDFVHWWLPEIASELGIKTIYFSVYMANIVMPSTSKLTGNKPSTVEDIKALQQSYGIPVKTFEAISLMNVFKSFHDWMDKCINGCNLMLIKSCREMEGSRIDDVTKQSTRPVFLIGPVVPEPHSGELDETWANWLNRFPAKSVIYCSFGSETFLTDDQIRELALGLELTGLPFFLVLNFPANVDKSAELKRTLPDGFLERVKDKGIVHSGWVQQRHILAHDSVGCYVFHAGYGSVIEGLVNDCQLVMLPMKVDQFTNSKVIALELKAGVEVNRRDEDGYFGKDDVFEAVESVMMDTENEPAKSIRENHRKLKEFLQNDEIQKKYIADFVENLKAL

SEQ ID NO: 115 - DNA, 1362 bp, Stevia rebaudiana
  CDS (1)..(1362)
atgtccttgaaaggtaacgacaaggaattacatttggtcatgttcccattctttgctttcggtcacatcactccatttgtccaattgtccaacaagatctcctctttgtacccaggtgtcaagatcactttcttggctgcttctgcttctgtttccagaatcgaaaccatgttgaacccatctaccaacaccaaggtcattccattgactttgccaagagtcgatggtctaccagaaggtgttgaaaacactgctgacgcttctccagctaccattggtctattggttgttgccattgatttgatgcaacctcaaatcaagactttattggctaacttgaagccagacttcgttatcttcgacttcgtccactggtggttaccagaaattgcttctgaattgggtatcaagaccatctacttctccgtttacatggccaacattgtcatgccatccacttccaagttgaccggtaacaagccatctaccgtcgaagatatcaaggctttgcaacaatctgacggtattccagttaagactttcgaagccatctctttgatgaacgttttcaagtctttccacgactggatggacaaatgtatcaacggttgtaacttgatgttgatcaagtcttgtcgtgaaatggaaggttccagaattgacgatgtcaccaagcaatctaccagaccagttttcttgattggtccagttgttccagaacctcactctggtgaattggacgaaacctgggctaactggttgaacagattcccagctaagtctgtcatctactgttcctttggttctgaaactttcttgaccgatgaccaaatcagagaattggccttgggtttagaattgactggtttgccattcttcttggtcttgaacttcccagccaatgtcgacaaatctgctgaattgaagagaactttaccagatggtttcttggaaagagttaaggacaagggtattgtccactctggttgggttcaacaaagacacatcttggctcatgactctgttggttgttacgttttccacgctggttacggttccgttatcgaaggtttggtcaatgactgtcaattagtcatgttgccaatgaaggttgaccaattcaccaactccaaggttattgctttggaattgaaggctggtgttgaagttaacagaagagatgaagatggttacttcggtaaggacgatgtcttcgaagctgtcgaatctgtcatgatggacactgaaaacgaaccagccaagtccatcagagaaaaccaccgtaaattgaaggaatttttgcaaaacgatgaaatccaaaagaaatacattgctgatttcgttgaaaacttgaaagcgtta

SEQ ID NO: 116 - protein, 454 aa, Stevia rebaudiana
MSLKGNDKELHLVMFPFFAFGHITPFVQLSNKISSLYPGVKITFLAASASVSRIETMLNPSTNTKVIPLTLPRVDGLPEGVENTADASPATIGLLVVAIDLMQPQIKTLLANLKPDFVIFDFVHWWLPEIASELGIKTIYFSVYMANIVMPSTSKLTGNKPSTVEDIKALQQSDGIPVKTFEAISLMNVFKSFHDWMDKCINGCNLMLIKSCREMEGSRIDDVTKQSTRPVFLIGPVVPEPHSGELDETWANWLNRFPAKSVIYCSFGSETFLTDDQIRELALGLELTGLPFFLVLNFPANVDKSAELKRTLPDGFLERVKDKGIVHSGWVQQRHILAHDSVGCYVFHAGYGSVIEGLVNDCQLVMLPMKVDQFTNSKVIALELKAGVEVNRRDEDGYFGKDDVFEAVESVMMDTENEPAKSIRENHRKLKEFLQNDEIQKKYIADFVENLKAL

SEQ ID NO: 117 - DNA, 1449 bp, Stevia rebaudiana
  CDS (1)..(1449)
atggaccaaatggccaagattgacgaaaagaagcctcacgttgttttcattccattcccagctcaatctcacatcaagtgtatgttgaaattggccagaattttgcaccaaaagggtttgtacatcactttcatcaacactgacaccaaccacgaaagattggttgcctccggtggtactcaatggttggaaaatgctccaggtttctggttcaagaccgtcccagatggtttcggttctgccaaggatgacggtgtcaagccaactgatgctttgagagaattgatggactacttgaagaccaacttcttcgatttgttcttggacttggtcttgaagttggaagttccagctacctgtatcatctgtgatggttgtatgacctttgctaacaccattagagctgctgaaaagttgaacattccagtcatcttattctggaccatggctgcttgtggtttcatggctttctaccaagctaaggtcttaaaggaaaaggaaattgttccagtcaaggacgaaacctacttgaccaatggttacttggacatggaaattgactggatcccaggtatgaagagaatcagattacgtgacttgcctgaattcatcttggccaccaagcaaaactactttgctttcgaattcttgtttgaaactgctcaattagctgacaaggtttctcacatgatcattcacactttcgaagaattggaagcttctttagtctctgaaatcaaatctattttcccaaacgtttacactatcggtccattacaattgttgttgaacaagatcactcaaaaggaaaccaacaacgattcttactctttatggaaggaagaaccagaatgtgtcgaatggttgaactccaaggaaccaaactccgttgtttacgtcaactttggttctttggctgtcatgtctttgcaagatttggtcgaattcggttggggtttggttaactccaaccattacttcttatggatcatcagagctaacttgattgacggtaagccagctgtcatgccacaagaattgaaggaagccatgaacgaaaaaggtttcgttggttcttggtgttcccaagaagaagttttgaaccatccagccgttggtggtttcttgactcactgtggctggggttccatcattgaatctctatccgctggtgttccaatgttgggttggccatccattggtgaccaaagagccaactgtcgtcaaatgtgtaaggaatgggaagttggtatggaaatcggtaagaacgttaagagagatgaagtcgaaaaattagtcagaatgttgatggaaggtttggaaggtgaaagaatgagaaagaaggctttggaatggaagaaatctgctactttggctacttgttgtaacggttcctcttctttggatgttgaaaaattggctaacgaaatcaagaaattgtccaggaac

SEQ ID NO: 118 - protein, 483 aa, Stevia rebaudiana
MDQMAKIDEKKPHVVFIPFPAQSHIKCMLKLARILHQKGLYITFINTDTNHERLVASGGTQWLENAPGFWFKTVPDGFGSAKDDGVKPTDALRELMDYLKTNFFDLFLDLVLKLEVPATCIICDGCMTFANTIRAAEKLNIPVILFWTMAACGFMAFYQAKVLKEKEIVPVKDETYLTNGYLDMEIDWIPGMKRIRLRDLPEFILATKQNYFAFEFLFETAQLADKVSHMIIHTFEELEASLVSEIKSIFPNVYTIGPLQLLLNKITQKETNNDSYSLWKEEPECVEWLNSKEPNSVVYVNFGSLAVMSLQDLVEFGWGLVNSNHYFLWIIRANLIDGKPAVMPQELKEAMNEKGFVGSWCSQEEVLNHPAVGGFLTHCGWGSIIESLSAGVPMLGWPSIGDQRANCRQMCKEWEVGMEIGKNVKRDEVEKLVRMLMEGLEGERMRKKALEWKKSATLATCCNGSSSLDVEKLANEIKKLSRN

SEQ ID NO: 119 - DNA, 1404 bp, Stevia rebaudiana
  CDS (1)..(1404)
atgccaatctccgatatcaatgctggttcccacattttggttttcccatacccagctcaaggtcacatgttgactctattagatttgacccaccaattggccatcagaaacttgactatcactatcttagtcaccccaaagaacttgccaaccatttctccattgttggctgctcatccaaccactgtttctgctttgttgttgccattaccacctcacccagccatcccatctggtattgaaaacgtcaaggacttgccaaacgatgctttcaaggctatgatggttgctttaggtgacttgtacaacccattgagagactggttcagaaaccaacctaacccaccagttgccatcatttctgacttcttcttgggttggactcaccacttggctgtcgaattaggtatcagaagatacactttctctccatctggtgctttggctttgtccgtcattttctctttatggagataccaaccaaagagaatcgatgtcgaaaacgaaaaggaagctatcaaattcccaaagattccaaactctccagaatacccatggtggcaattatctccaatctacagatcttacgttgaaggtgacccagattctgaattcatcaaggatggtttcttggctgatattgcttcctggggtattgtcatcaactctttcaccgaattggaacaagtctacgttgaccatttgaagcatgaattgggtcacgaccaagtctttgctgtcggtccattattgcctccaggtgacaagacttctggtagaggtggttcttcttccaacgatgtcttgtcctggttggacacctgtgctgacagaaccgttgtctacgtttgtttcggttctcaaatggttttgaccaacggtcaaatggaagttgttgctttgggtttggaaaagtcccgtgtcaaatttgtctggtccgtcaaggaaccaactgttggtcacgaagctgctaactacggtcgtgttccaccaggtttcgaagacagagtttccggtcgtggtttggttatcagaggttgggttccacaagttgccattttgtctcacgactccgttggtgttttcttgacccactgtggttggaactctgtcatggaagctgttgctgctgaagttttgatgttgacctggccaatgtccgctgaccaattctccaatgccactttgttgcacgaattgaaggttggtatcaaggtttgtgaaggttccaacattgtcccaaactctgacgaattggctgaattgttctccaaatctctatccgatgaaactagattggaaagaaagagagtcaaggaatttgccaaatctgccaaggaagccgtcggtccaaagggttcctctgtcggtgaattagaaagattggttgacaacttgtctttg

SEQ ID NO: 120 - protein, 468 aa, Stevia rebaudiana
MPISDINAGSHILVFPYPAQGHMLTLLDLTHQLAIRNLTITILVTPKNLPTISPLLAAHPTTVSALLLPLPPHPAIPSGIENVKDLPNDAFKAMMVALGDLYNPLRDWFRNQPNPPVAIISDFFLGWTHHLAVELGIRRYTFSPSGALALSVIFSLWRYQPKRIDVENEKEAIKFPKIPNSPEYPWWQLSPIYRSYVEGDPDSEFIKDGFLADIASWGIVINSFTELEQVYVDHLKHELGHDQVFAVGPLLPPGDKTSGRGGSSSNDVLSWLDTCADRTVVYVCFGSQMVLTNGQMEVVALGLEKSRVKFVWSVKEPTVGHEAANYGRVPPGFEDRVSGRGLVIRGWVPQVAILSHDSVGVFLTHCGWNSVMEAVAAEVLMLTWPMSADQFSNATLLHELKVGIKVCEGSNIVPNSDELAELFSKSLSDETRLERKRVKEFAKSAKEAVGPKGSSVGELERLVDNLSL

SEQ ID NO: 121 - DNA, 1383 bp, Stevia rebaudiana
  CDS (1)..(1383)
atggaatcttccaaggtcattttgtacccatctccaggtattggtcacttggtttccatggtcgaattgggtaaattgattcacacccaccacccatctctatccgtcatcatcttggttttgccagctacctacgaaactggttccaccaccacctacatcaacactgtttctaccaccactccattcatcactttccaccacttgccagtcattccattgccaccagactcctcttctgaatttatcgatttggctttcgacattccacaattatacaacccagttgtctacaacactttggttgccatctctgaaacttccaccatcaaggctgttatcttggacttctttgtcaacgccgctttccaaatctccaagtctttggacttgccaacctactacttcttcacttctggtgcttctggtctatgtgctttcttgcatttgccaactatctacaagacctactccggtaacttcaaggacttggacactttcatcaacattccaggtgttcctcctatccactcttctgacatgccaaccgtcttattcgacaaggaatccaactcttacaagaactttgtcaagacttccaacaacatggccaaatcttctggtgtcattgctaactccttcttgcaattggaagaaagagctgctcaaactttgagagatggtaagtccatcaccgatggtccatctccaccaatctacttgattggtccattgatcgcttctggtaaccaagttgaccataatgaaaacgaatgtttgaaatggttaaacactcaaccatccaaatctgttgttttcttgtgtttcggttctcaaggtgttttcaagaaggaacaattgaaggaaattgctgttggtttggaaagatctggtcaaagattcttatgggttgtcagaaagcctccatctgatggtggtaaggaattcggtttggatgacgtcttgccagaaggtttcgttgccagaaccaaggaaaagggtttggttgtcaagaactgggctccacaaccagctattttgggtcacgaatctgtcggtggtttcgtttcccactgtggttggaactcttctttggaagccgttgttttcggtgtcccaatggttgcttggccattatacgctgaacaaaagatgaaccgtgtctacttggtcgaagaaatcaaggttgctttatggttaagaatgtccgctgatggttttgtctctgctgaagctgttgaagaaactgtcagacaattgatggacggtagaagagttcgtgaaagaattttggaaatgtccaccaaggccaaggccgctgtcgaagatggtggttcttccagagttgacttcttcaaattgactgaatcctggacccacaag

SEQ ID NO: 122 - protein, 461 aa, Stevia rebaudiana
MESSKVILYPSPGIGHLVSMVELGKLIHTHHPSLSVIILVLPATYETGSTTTYINTVSTTTPFITFHHLPVIPLPPDSSSEFIDLAFDIPQLYNPVVYNTLVAISETSTIKAVILDFFVNAAFQISKSLDLPTYYFFTSGASGLCAFLHLPTIYKTYSGNFKDLDTFINIPGVPPIHSSDMPTVLFDKESNSYKNFVKTSNNMAKSSGVIANSFLQLEERAAQTLRDGKSITDGPSPPIYLIGPLIASGNQVDHNENECLKWLNTQPSKSVVFLCFGSQGVFKKEQLKEIAVGLERSGQRFLWVVRKPPSDGGKEFGLDDVLPEGFVARTKEKGLVVKNWAPQPAILGHESVGGFVSHCGWNSSLEAVVFGVPMVAWPLYAEQKMNRVYLVEEIKVALWLRMSADGFVSAEAVEETVRQLMDGRRVRERILEMSTKAKAAVEDGGSSRVDFFKLTESWTHK

SEQ ID NO: 123 - DNA, 1455 bp, Stevia rebaudiana
  CDS (1)..(1455)
atgtacaacgttacttaccatcaaaactccaaggccatggctacctctgactccattgtcgacgacagaaagcaattgcacgttgccactttcccatggttggctttcggtcacatcttgccattcttgcaattgtccaaattgattgctgaaaagggtcacaaagtctctttcttgtctaccaccagaaacatccaaagattgtcctctcacatctctccattgattaacgttgtccaattgactttaccaagagtccaagaattgccagaagatgctgaagctactactgatgttcacccagaagatatccaatacttgaagaaggctgtcgatggtttgcaaccagaagttaccagattcttggaacaacactctccagactggatcatctacgacttcactcactactggttaccatccattgctgcttctttgggtatctccagagcttacttctgtgttatcactccatggaccattgcttacttggctccatcttctgatgccatgatcaacgactctgatggtagaaccactgttgaagatttgaccaccccacctaaatggttcccattcccaaccaaggtctgttggagaaagcatgatttggccagaatggaaccatacgaagctccaggtatctctgacggttacagaatgggtatggttttcaagggttctgactgtttgttgttcaaatgttaccatgaattcggtactcaatggttacctctattagaaactttgcaccaagttccagttgttccagtcggtttgttgcctccagaaatcccaggtgacgaaaaggacgaaacctgggtttccatcaagaaatggttggatggtaagcaaaagggttccgttgtctacgttgctttaggttctgaagctttagtctctcaaactgaagttgtcgaattggctttgggtttggaattgtccggtttgccatttgtctgggcttacagaaagccaaagggtccagccaagtctgattctgtcgaattaccagatggtttcgtcgaaagaacccgtgaccgtggtttggtctggacttcctgggctccacaattgagaattttgtcccacgaatctgtctgtggtttcttgactcactgtggttctggttccattgttgaaggtttgatgttcggtcacccattgatcatgttgccaatcttctgtgaccaaccattaaacgctagattgttggaagacaagcaagtcggtattgaaattccaagaaacgaagaagacggttgtttgaccaaggaatccgttgccagatctttgagatctgttgttgtcgaaaacgaaggtgaaatctacaaggctaacgctcgtgctctatccaagatctacaacgacaccaaggtcgaaaaggaatacgtttctcaatttgttgactacttggaaaagaacgccagagctgttgccattgaccacgaaagt

SEQ ID NO: 124 - protein, 485 aa, Stevia rebaudiana; identical to SEQ ID NO: 108

SEQ ID NO: 125 - DNA, 1485 bp, Stevia rebaudiana
  CDS (1)..(1485)
atgtctccaaagatggttgctccaccaaccaacttgcacttcgtcttattcccattgatggctcaaggtcacttggttccaatggtcgacattgctagaattttggctcaaagaggtgctaccgtcaccatcatcaccactccataccatgccaacagagtcagaccagttatctccagagccattgctaccaacttgaaaatccaattgttggaattgcaattgagatccactgaagctggtttgccagaaggttgtgaatctttcgaccaattgccatctttcgaatactggaagaacatctccactgccattgacttgttgcaacaaccagctgaagatctattgagagaattgtctccacctccagactgtatcatctccgatttcttgttcccatggaccactgatgtcgccagaagattgaacattccaagattggttttcaacggtccaggttgtttctacttgttgtgtatccacgttgccatcacttctaacatcttaggtgaaaacgaacctgtttcctccaacactgaaagagttgttttgccaggtttaccagatcgtattgaagttaccaaattgcaaatcgtcggttcttccagaccagctaacgttgacgaaatgggttcctggttaagagctgtcgaagctgaaaaggcttctttcggtattgtcgtcaacacctttgaagaattggaaccagaatacgtcgaagaatacaagaccgtcaaggacaagaagatgtggtgtatcggtccagtttctctatgtaacaagactggtccagacttggctgaaagaggtaacaaggctgccatcaccgaacacaactgtttgaaatggttggatgaaagaaagttgggttctgtcttgtacgtttgtttgggttctttggccagaatctccgctgctcaagccattgaattaggtttaggtttggaatctatcaacagaccatttatctggtgtgttagaaacgaaactgatgaattgaagacttggttcttggacggtttcgaagaaagagttcgtgacagaggtttgattgttcacggttgggctccacaagttttgatcttatctcacccaaccattggtggtttcttgactcactgtggttggaactctaccattgaatccatcactgctggtgttccaatgatcacctggccattctttgctgaccaattcttgaatgaagctttcatcgttgaagttttgaaaattggtgtcagaatcggtgttgaaagagcttgtttgttcggtgaagaagacaaggtcggtgtcttagtcaagaaggaagatgttaagaaggctgttgaatgtttgatggacgaagatgaagacggtgaccaaagaagaaagcgtgtcattgaattggccaagatggctaagattgctatggctgaaggtggttcttcttacgaaaacgtttcctctttgatcagagatgtcactgaaactgtccgtgctcctcat

SEQ ID NO: 126 - protein, 495 aa, Stevia rebaudiana
MSPKMVAPPTNLHFVLFPLMAQGHLVPMVDIARILAQRGATVTIITTPYHANRVRPVISRAIATNLKIQLLELQLRSTEAGLPEGCESFDQLPSFEYWKNISTAIDLLQQPAEDLLRELSPPPDCIISDFLFPWTTDVARRLNIPRLVFNGPGCFYLLCIHVAITSNILGENEPVSSNTERVVLPGLPDRIEVTKLQIVGSSRPANVDEMGSWLRAVEAEKASFGIVVNTFEELEPEYVEEYKTVKDKKMWCIGPVSLCNKTGPDLAERGNKAAITEHNCLKWLDERKLGSVLYVCLGSLARISAAQAIELGLGLESINRPFIWCVRNETDELKTWFLDGFEERVRDRGLIVHGWAPQVLILSHPTIGGFLTHCGWNSTIESITAGVPMITWPFFADQFLNEAFIVEVLKIGVRIGVERACLFGEEDKVGVLVKKEDVKKAVECLMDEDEDGDQRRKRVIELAKMAKIAMAEGGSSYENVSSLIRDVTETVRAPH

SEQ ID NO: 127 - DNA, 1272 bp, Stevia rebaudiana
  CDS (1)..(1272)
atgttgcaattggctacctacttgcactctcaaggtatctccatcactattgctcaatacccaaacttcaactctccagactcctccaaccacccagaattgactttcttaccattatcttccggtaacttgtccgttgctgatatctctggtggtttcttcaaattcattcaaaccttgaaccacaactgtaagcctcacttcagagaatacttggttcaaaacatgtcctctgatgacaaggaatccattgtcatcatcagagacaacttgatgttctttgctggtgaaatcgctggtgaattaggtttaccatctatcatcttgagaggttctaacgctgtcatgttgactgcttccgatatcattccacaattgcaccaagaaggtagattcccaccaccagactctctattgcaagaaaccattccagaattggttccattcagatacaaggacttgccattcatcggttacccaattcaccaaaccttggaattctccattaccatgatgaccccaaagtctccagcttctgccatcttgatcaacactttagaattcttggaacaatctgctttgactcaaatccgtgaccactacaaggtcccagttttcactatcggtccattgcacaagattgtcactaccagatccacttccatcttggaagaagacacctcttgtatcaactggttggacaagcaatctccaaagtctgttgtctacgtttctctaggttctttggccaaattggacgaaaaggttgcttctgaaatggcttgtggtttggccatgtccaaccataaattcttatgggttgtcagaccaggtatggtccatggtttcgaatgggttgaatttttgccagactctttggttggtgaaatgaaggccagaggtttgattgtcaaatgggctccacaaaccactgttttggctcacaacgctgtcggtggtttttggtcccactgtggttggaactctactatcgaatgtttggctgaaggtgttccaatgatgtgtcaacctttcttcgctgaccaattgttgaatgctcgttacgtttccgatgtctggaagaccggtttcgaaattgtcattgaaaagggtgaaattgcttgtgccatcaagagagttttggtcgatgaagaaggtgaagaaatgagacaaagagctatggaaatcaaggaaaaggtcaagattgccatcaacgatggtggttcttcttacgactctttcaaggatttggttgctttcatctcctctttg

SEQ ID NO: 128 - protein, 424 aa, Stevia rebaudiana
MLQLATYLHSQGISITIAQYPNFNSPDSSNHPELTFLPLSSGNLSVADISGGFFKFIQTLNHNCKPHFREYLVQNMSSDDKESIVIIRDNLMFFAGEIAGELGLPSIILRGSNAVMLTASDIIPQLHQEGRFPPPDSLLQETIPELVPFRYKDLPFIGYPIHQTLEFSITMMTPKSPASAILINTLEFLEQSALTQIRDHYKVPVFTIGPLHKIVTTRSTSILEEDTSCINWLDKQSPKSVVYVSLGSLAKLDEKVASEMACGLAMSNHKFLWVVRPGMVHGFEWVEFLPDSLVGEMKARGLIVKWAPQTTVLAHNAVGGFWSHCGWNSTIECLAEGVPMMCQPFFADQLLNARYVSDVWKTGFEIVIEKGEIACAIKRVLVDEEGEEMRQRAMEIKEKVKIAINDGGSSYDSFKDLVAFISSL

SEQ ID NO: 129 - DNA, 1422 bp, Stevia rebaudiana
  CDS (1)..(1422)
atgtctacctctgaattggttttcattccatctccaggtgctggtcatttgccaccaactgttgaattggccaaattgttgttgcaccgtgaccaaagattgtctgtcaccatcattgtcatgaacttatggttaggtccaaagcacaacactgaagccagaccatgtgttccttccttgagattcgtcgatatcccatgtgacgaatctaccatggctttgatctctccaaacactttcatctctgcctttgtcgaacaccacaagccaagagttcgtgacatcgttcgtggtatcattgaatctgactctgtcagattggctggtttcgtcttggacatgttctgtatgccaatgtccgatgttgctaacgaatttggtgttccatcttacaactacttcacctctggtgctgccactttaggtttgatgttccatttgcaatggaagagagatcacgaaggttacgacgctactgaattgaagaactctgacactgaattatctgtcccatcttacgttaaccctgttccagccaaggtcttgccagaagttgttttggacaaggaaggtggttccaagatgttcttggatttggctgaaagaatcagagaatccaagggtatcatcgttaactcttgtcaagctattgaaagacacgctttggaatacctatcctccaacaacaacggtattccacctgttttcccagtcggtccaatcttgaacttggaaaacaagaaggacgatgctaagactgacgaaatcatgagatggttgaacgaacaaccagaatcctctgttgttttcttgtgtttcggttccatgggttctttcaacgaaaagcaagtcaaagaaattgctgttgccattgaaagatctggtcacagatttttatggtctttgagaagaccaactccaaaggaaaagattgaattcccaaaggaatacgaaaacttggaagaagtcttaccagaaggtttcttgaagagaacctcttctatcggtaaggttatcggttgggctccacaaatggctgtcttgtcccacccatccgtcggtggtttcgtttcccactgtggttggaactccactttggaatccatgtggtgtggtgtcccaatggctgcttggccattatacgctgaacaaactttgaatgctttcttgttggttgtcgaattgggtttggctgctgaaattagaatggactacagaaccgataccaaggctggttacgatggtggtatggaagtcaccgttgaagaaattgaagacggtatcagaaagttgatgtctgacggtgaaatcagaaacaaggtcaaggatgtcaaggaaaaatccagagctgccgttgttgagggtggttcttcttacgcttccattggtaaattcatcgaacacgtttccaacgtcaccata

SEQ ID NO: 130 - protein, 474 aa, Stevia rebaudiana
MSTSELVFIPSPGAGHLPPTVELAKLLLHRDQRLSVTIIVMNLWLGPKHNTEARPCVPSLRFVDIPCDESTMALISPNTFISAFVEHHKPRVRDIVRGIIESDSVRLAGFVLDMFCMPMSDVANEFGVPSYNYFTSGAATLGLMFHLQWKRDHEGYDATELKNSDTELSVPSYVNPVPAKVLPEVVLDKEGGSKMFLDLAERIRESKGIIVNSCQAIERHALEYLSSNNNGIPPVFPVGPILNLENKKDDAKTDEIMRWLNEQPESSVVFLCFGSMGSFNEKQVKEIAVAIERSGHRFLWSLRRPTPKEKIEFPKEYENLEEVLPEGFLKRTSSIGKVIGWAPQMAVLSHPSVGGFVSHCGWNSTLESMWCGVPMAAWPLYAEQTLNAFLLVVELGLAAEIRMDYRTDTKAGYDGGMEVTVEEIEDGIRKLMSDGEIRNKVKDVKEKSRAAVVEGGSSYASIGKFIEHVSNVTI

SEQ ID NO: 131 - DNA, 1437 bp, Stevia rebaudiana
  CDS (1)..(1437)
atggcctccattgctgaaatgcaaaagcctcatgccatctgtatcccatacccagctcaaggtcacatcaacccaatgatgcaatttgccaaattgttgcacttcaagggtttccacatctctttcgttaacaaccattacaaccacaagagattacaaagatctagaggtctatccgctttggaaggtttgccagacttccacttctactccatcccagatggtttgcctccatctaacgctgaagctactcaatccattccaggtctatgtgaatctattccaaagcactctttggaaccattctgtgacttgattgccactttgaatggttctgatgttccaccagtctcctgtatcatctctgacggtgtcatgtctttcactttgcaagctgctgaaagattcggtttaccagaagtcttattctggactccatctgcttgtggtttcttggcttacactcactacagagatttggttgacaaagaatacattccattgaaggacaccaatgatttgaccaacggttacttggaaacttctttggactggatcccaggtatgaagaacatcagattaaaggacttcccatctttcatcagaaccaccgatatcaacgatatcatgttgaactacttcttgattgaaactgaagccattccaaagggtgttgccatcatcttgaacactttcgatgctttggaaaaggactctatcactccagtcttggctttgaaccctcaaatctacaccatcggtccattgcacatgatgcaacaatacgtcgaccatgatgaaagattgaagcacattggttccaacttatggaaggaagacgtttcttgtatcaactggttggacaccaagaagccaaactccgttgtctacgtcaactttggttccatcactgttatgaccaaggaacaattgattgaattcggttggggtttggctaactctaagaaggacttcttatggatcaccagaccagacattgttggtggtaacgaagctatgattccagctgaattcattgaagaaaccaaggaaagaggtatggttacttcctggtgttcccaagaagaagttttgaagcacccatccattggtgttttcttgacccactctggttggaactccaccattgaatccatctctaacggtgttccaatgatctgttggccattcttcgctgaacaacaaaccaactgtcgttactgttgtgtcgaatgggaaatcggtttggaaattgacactgacgtcaagcgtgaagaagttgaagctcaagttagagaaatgatggatggttctaagggtaagatgatgaaaaacaaggctttggaatggaagaagaaggctgaagaagctgtctctattggtggttcttcttacttgaactttgaaaaattggtcaccgatgtcttgttgcgcaaa

SEQ ID NO: 132 - protein, 479 aa, Stevia rebaudiana
MASIAEMQKPHAICIPYPAQGHINPMMQFAKLLHFKGFHISFVNNHYNHKRLQRSRGLSALEGLPDFHFYSIPDGLPPSNAEATQSIPGLCESIPKHSLEPFCDLIATLNGSDVPPVSCIISDGVMSFTLQAAERFGLPEVLFWTPSACGFLAYTHYRDLVDKEYIPLKDTNDLTNGYLETSLDWIPGMKNIRLKDFPSFIRTTDINDIMLNYFLIETEAIPKGVAIILNTFDALEKDSITPVLALNPQIYTIGPLHMMQQYVDHDERLKHIGSNLWKEDVSCINWLDTKKPNSVVYVNFGSITVMTKEQLIEFGWGLANSKKDFLWITRPDIVGGNEAMIPAEFIEETKERGMVTSWCSQEEVLKHPSIGVFLTHSGWNSTIESISNGVPMICWPFFAEQQTNCRYCCVEWEIGLEIDTDVKREEVEAQVREMMDGSKGKMMKNKALEWKKKAEEAVSIGGSSYLNFEKLVTDVLLRK

SEQ ID NO: 133 - DNA, 1374 bp, Stevia rebaudiana
  CDS (1)..(1374)
atggaaaacaagactgaaactaccgttcgtcgtagaagaagaatcatcttattcccagttccagttcaaggtcacatcaacccaattttgcaattggctaacgtcttatactccaagggtttctccatcactattttccacactaacttcaacaagccaaagacctccaactacccacacttcaccttcagatttattttggacaatgaccctcaagatgtcagaatctccaacttgccaactcacggtccattgaccgtcatgagaattttgatcatcaacgaacacggtgctgatgaattgcaaagagaattggaattgttgatgttggcctccgaagaagacggtgaagtctcctgtttgattaccgaccaaatctggtacttcacccaatctgttgctgactctttgaacttgagaagattggttttgatgacttcttctttgttcaacttccacgctcatgtttctttgcctcaattcgatgaattgggttacttggacccagacgacaagactagattagaagaacaagcttctggtttcccaatgttgaaggtcaaggatatcaaatgtggtttctctatgtggaagcaaggtaaggaaatctttgaaaacatcaccaagcaaaccaaggcttcttctggtgtcatctggaactctttcaaggaattggaagaatctgaattggaaaccgtcatcagagaaatcccagctccatccttcttgattccattgccaaagcatttgactgcttcctcttcttctctattagaccacgacagaactgttttcccatggttagaccaacaaccatctcgttctgtcttgtacgtttctttcggttctgctactgaagtcgatgctaaggacttcttggaaattgctcgtggtttggtcgactccaagcaatctttcttatgggttgttagaccaggtttcgtcaagggttccacctgggttgaaccattgccagatggtttcttgggtgaaagaggtagaattgtcaaatgggttccacaacaagaagttttggctcacggtgccattggtgctttctggacccactctggttggaactccactttggaatccgtttgtgaaggtgttccaatgattttctctgcctttgcctttgaccaaccattaaacgctagatacatgtccgatgtcttgaaggttggtgtctacttggaaaacggttgggaaagaggtgaaattgccaacgccatcagaagagttatggtcgatgaagaaggtggttacatcagacaaaacgcttccgtcttgaagcaaaaggctgatgtttccttgatgaagggtggttcttcttacgaatctctagaatctttggttgcttacatctccagctta

SEQ ID NO: 134 - protein, 458 aa, Stevia rebaudiana
MENKTETTVRRRRRIILFPVPVQGHINPILQLANVLYSKGFSITIFHTNFNKPKTSNYPHFTFRFILDNDPQDVRISNLPTHGPLTVMRILIINEHGADELQRELELLMLASEEDGEVSCLITDQIWYFTQSVADSLNLRRLVLMTSSLFNFHAHVSLPQFDELGYLDPDDKTRLEEQASGFPMLKVKDIKCGFSMWKQGKEIFENITKQTKASSGVIWNSFKELEESELETVIREIPAPSFLIPLPKHLTASSSSLLDHDRTVFPWLDQQPSRSVLYVSFGSATEVDAKDFLEIARGLVDSKQSFLWVVRPGFVKGSTWVEPLPDGFLGERGRIVKWVPQQEVLAHGAIGAFWTHSGWNSTLESVCEGVPMIFSAFAFDQPLNARYMSDVLKVGVYLENGWERGEIANAIRRVMVDEEGGYIRQNASVLKQKADVSLMKGGSSYESLESLVAYISSL

SEQ ID NO: 135 - DNA, 1377 bp, Stevia rebaudiana
  CDS (1)..(1377)
atggaaaacaagactgaaactactgtcagaagaagacgtcgtatcatcttgttcccagttccattccaaggtcacatcaacccaatgttacaattagctaacgtcttgtactccaagggtttctccatcaccattttccacaccaacttcaacaagccaaagacttctaactacccacacttcactttcagatttatcttggacaacgaccctcaagatgtcagaatttccaacttgccaacccacggtccattggctgtcatgagaattttgatcatcaacgaacacggtgccgacgaattgagaagagaattggaattgttgatgttggcttctgaagaagatggtgaagtttcctgtttgattgctgaccaaatctggtacttcacccaatctgttgctgactctttgaacttgagaagattggtcttggtcacttcttctttgttcaacttccacgctcatgtctctttgccacaatttgacgaattgggttacttggacccagatgacaagaccagattggaagaacaagcttctggtttcccaatgttgaaggttaaggatatcaaatgttctttctccatgtggaagaaatacaaggaatactttgaaaacatcaccaagcaaaccaaggcctcctccggtgttatctggaactctttcaaggaattagaagaatctgaattggaaactgttatcagagaaattccagctccatctttcttaatcccattaccaaagcatttgactgcttcttcttcctctttgttggaccacgacagaaccgttttcccatggttggaccaacaaccatccagatctgtcttgtacgtttctttcggttctggtactgaagtcttagatgaaaaggacttcttggaaattgccagaggtttagtcgactccaagcaatctttcttgtgggttgttagaccaggtttcgtcaagggttccacctgggttgaaccattgccagatggtttcttgggtgaaagaggtagaattgtcaaatgggttcctcaacaagaagttttggctcacggtgccattggtgctttctggacccactctggttggaactccactttggaatctgtttgtgaaggtgttccaatgattttctccgatttcggtctagaccaaccattgaacgctcgttacatgtccgatgttttgaaggttggtgtctacttggaaaacggttgggaaagaggtgaaattgctaacgccatcagaagagtcatggttgacgaagaaggtgaatacatcagacaaaatgctcgtgtcttgaaacaaaaggctgatgtttctttgatgaagggtggttcttcttacgaatccttggaatctttagtctcttacatctcctcctta

SEQ ID NO: 136 - protein, 459 aa, Stevia rebaudiana
MENKTETTVRRRRRIILFPVPFQGHINPMLQLANVLYSKGFSITIFHTNFNKPKTSNYPHFTFRFILDNDPQDVRISNLPTHGPLAVMRILIINEHGADELRRELELLMLASEEDGEVSCLIADQIWYFTQSVADSLNLRRLVLVTSSLFNFHAHVSLPQFDELGYLDPDDKTRLEEQASGFPMLKVKDIKCSFSMWKKYKEYFENITKQTKASSGVIWNSFKELEESELETVIREIPAPSFLIPLPKHLTASSSSLLDHDRTVFPWLDQQPSRSVLYVSFGSGTEVLDEKDFLEIARGLVDSKQSFLWVVRPGFVKGSTWVEPLPDGFLGERGRIVKWVPQQEVLAHGAIGAFWTHSGWNSTLESVCEGVPMIFSDFGLDQPLNARYMSDVLKVGVYLENGWERGEIANAIRRVMVDEEGEYIRQNARVLKQKADVSLMKGGSSYESLESLVSYISSL

SEQ ID NO: 137 - DNA, 1419 bp, Stevia rebaudiana
  CDS (1)..(1419)
atggctacttctgactccattgtcgatgacagaaagcaattgcacgttgccactttcccatggttggctttcggtcacattttgccattcttgcaattgtccaaattgattgctgaaaagggtcacaaggtttctttcttgtccactaccagaaacatccaaagattatcttctcacatctctccattgatcaacgttgtccaattgactttgccaagagtccaagaattgccagaagatgctgaagctaccaccgatgtccacccagaagatatccaatacttgaagaaggctgtcgatggtttgcaaccagaagtcaccagattcttggaacaacactctccagactggatcatctacgacttcacccactactggttaccatccattgctgcttctttgggtatctccagagcttacttctgtgtcatcactccatggaccattgcttacttggctccatcttctgatgccatgatcaacgactctgacggtagaaccactgttgaagatttgaccactccacctaaatggttcccattcccaaccaaggtttgttggagaaagcatgacttggccagaatggaaccttacgaagctccaggtatttctgatggttacagaatgggtatggttttcaagggttctgactgtctattattcaaatgttaccatgaattcggtactcaatggttgccattgttggaaactttgcaccaagttccagttgttccagtcggtttgttgccaccagaaattccaggtgatgaaaaggatgaaacctgggtttccatcaagaaatggttggacggtaagcaaaagggttccgttgtctacgttgctttgggttctgaagctttggtttctcaaactgaagttgtcgaattggctttgggtctagaattgtccggtttaccatttgtctgggcttacagaaagccaaagggtccagccaaatctgattccgtcgaattaccagacggtttcgtcgaaagaacccgtgaccgtggtttagtctggacttcctgggctccacaattgagaatcttgtcccacgaatccgtttgtggtttcttgactcactgtggttctggttctattgtcgaaggtttgatgttcggtcacccattgattatgttgcctttgtttggtgaccaaccattaaacgctagattattggaagacaagcaagtcggtatcgaaattccaagaaacgaagaagacggttgtttgaccaaggaatccgttgctcgttctttgagatccgttgttgtcgaaaacgaaggtgaaatctacaaggccaacgccagagaattgtctaagatctacaacgacaccaaggttgaaaaggaatacgtttctcaatttgtcgactacttggaaaagaacgctagagctgttgccatcgaccacgaaagc

SEQ ID NO: 138 - protein, 473 aa, Stevia rebaudiana; identical to SEQ ID NO: 110

SEQ ID NO: 139 - DNA, 1419 bp, Stevia rebaudiana
  CDS (1)..(1419)
atggctacctctgactccattgtcgatgaccgtaaacaattgcacgttgctactttcccatggttggctttcggtcacatcttgccttacttgcaattgtccaagttgattgctgaaaagggtcacaaggtttctttcttgtccactactagaaacatccaaagattatcttctcacatctctccattgatcaacgttgtccaattgactttgccaagagttcaagaattaccagaagatgctgaagctaccaccgatgtccacccagaagacattccatacttgaagaaggcctctgacggtttgcaaccagaagtcactagattcttggaacaacactctccagactggatcatctacgactacactcactactggttgccatccattgctgcttctttgggtatctccagagcccatttctccgtcaccactccatgggctattgcttacatgggtccatctgctgatgctatgatcaacggttctgacggtagaaccaccgtcgaagatttgactaccccacctaaatggttcccattcccaaccaaggtttgttggagaaagcatgatttggccagattagtcccatacaaggctccaggtatttctgatggttacagaatgggtttggtcttgaaaggttctgactgtttgttgtccaaatgttaccacgaattcggtactcaatggttaccattgttggaaactttgcaccaagttccagttgttccagtcggtttgttgcctccagaagttccaggtgacgaaaaggatgaaacctgggtttccatcaagaaatggttggatggtaagcaaaagggttccgttgtctacgttgctttgggttctgaagtcttggtcagccaaactgaagttgtcgaattggctttaggtttggaattgtccggtctaccatttgtctgggcttacagaaagccaaagggtccagctaagtctgactccgttgaattgccagatggtttcgtcgaaagaaccagagacagaggtttggtttggacttcttgggctccacaattgagaatcttatctcacgaatctgtttgtggtttcttgacccactgtggttctggttccatcgtcgaaggtttgatgttcggtcacccattaatcatgttgccaattttcggtgaccaaccattgaacgccagattattggaagacaagcaagtcggtattgaaattccaagaaacgaagaagatggttgtttgaccaaggaatccgttgccagatctctacgttctgttgttgtcgaaaaggaaggtgaaatctacaaggccaacgctcgtgaattatccaagatctacaacgacaccaaggttgaaaaggaatacgtttctcaatttgttgactacttggaaaagaacactagagctgttgccattgaccatgagtct

SEQ ID NO: 140 - protein, 473 aa, Stevia rebaudiana; identical to SEQ ID NO: 106

SEQ ID NO: 141 - DNA, 2361 bp, Stevia rebaudiana
atgaaaaccggtttcatctctcccgccactgttttccaccaccgaatctcccccgccaccaccttccgacaccacctctcccctgccaccaccaactccactggtattgttgctctgcgagacatcaacttccgatgcaaggctgtttccaaggagtactccgatctgctccagaaggacgaggcctctttcaccaagtgggacgacgacaaggtcaaggaccacctcgacaccaacaagaacctctaccccaacgacgagatcaaggagtttgtcgagtccgtcaaggccatgttcggctccatgaacgacggcgagattaatgtctctgcttacgacaccgcctgggttgctctggtccaggatgtcgacggttccggctctcctcagttcccttcctctctcgagtggatcgccaacaaccagctgtccgacggttcttggggtgaccacctgctcttctctgctcacgaccgaatcatcaacaccctggcctgtgtcattgctctgacctcttggaacgtccacccctccaagtgcgagaagggtctgaacttcctccgagagaacatctgcaagctcgaggacgagaacgccgagcacatgcccattggcttcgaggtcaccttcccctctctgattgacattgccaagaagctcaacattgaggtccccgaggacacccccgctctcaaggagatctacgctcgacgagacatcaagctcaccaagatccccatggaggttctccacaaggtccccaccactctcctccactctctcgagggtatgcccgatctcgagtgggagaagctgctcaagctgcagtgcaaggacggctctttcctcttctccccctcttccactgccttcgccctcatgcagaccaaggacgagaagtgtctccagtacctcaccaacattgtcaccaagttcaacggtggtgtccccaacgtctaccccgttgacctctttgagcacatctgggttgttgaccgactccagcgactcggtatcgcccgatacttcaagtccgagatcaaggactgtgtcgagtacatcaacaagtactggaccaagaacggtatctgctgggcccgaaacacccacgtccaggacattgacgacaccgccatgggcttccgagttctgcgagcccacggctacgatgtcacccccgatgtctttcgacagtttgagaaggacggcaagtttgtctgtttcgccggtcagtccacccaggccgtcaccggtatgttcaacgtctaccgagcttctcagatgctcttccccggtgagcgaatcctcgaggacgccaagaagttctcctacaactacctcaaggagaagcagtccaccaacgagctgctcgacaagtggatcattgccaaggatctgcccggtgaggttggctacgccctcgacatcccctggtacgcctctctgccccgactggagactcgatactacctcgagcagtacggtggtgaggacgatgtctggatcggtaagaccctgtaccgaatgggctacgtttccaacaacacctacctcgagatggccaagctcgactacaacaactacgttgccgtcctccagctcgagtggtacaccatccagcagtggtacgtcgacattggtatcgagaagttcgagtccgacaacatcaagtccgtccttgtctcctactacctcgctgctgcctccatcttcgagcccgagcgatccaaggagcgaattgcctgggccaagaccaccatcctcgtcgacaagatcacctccatcttcgactcctcccagtcctccaaggaagatatcaccgccttcattgacaagttccgaaacaagtcctcctccaagaagcactccatcaacggcgagccctggcacgaggtcatggttgctctcaagaaaactctccacggctttgccctcgacgctctgatgacccactctcaggacatccacccccagctccaccaggcctgggagatgtggctcaccaagctccaggacggtgttgatgtcactgctgagctcatggtccagatgatcaacatgaccgccggccgatgggtttccaaggagctcctcacccacccccagtaccagcgactctccactgtcaccaactctgtctgccacgacatcaccaagctccacaacttcaaggagaactccaccaccgtcgactccaaggtccaggagctggtccagctcgttttctccgacacccccgatgatctcgaccaggacatgaagcagaccttcctgactgtcatgaaaactttctactacaaggcctggtgcgaccccaacaccatcaacgaccacatctccaaggtctttgagattgtgatt

SEQ ID NO: 142 - DNA, 2229 bp, Stevia rebaudiana
atgtgcaaggctgtttccaaggagtactccgatctgctccagaaggacgaggcctctttcaccaagtgggacgacgacaaggtcaaggaccacctcgacaccaacaagaacctctaccccaacgacgagatcaaggagtttgtcgagtccgtcaaggccatgttcggctccatgaacgacggcgagattaatgtctctgcttacgacaccgcctgggttgctctggtccaggatgtcgacggttccggctctcctcagttcccttcctctctcgagtggatcgccaacaaccagctgtccgacggttcttggggtgaccacctgctcttctctgctcacgaccgaatcatcaacaccctggcctgtgtcattgctctgacctcttggaacgtccacccctccaagtgcgagaagggtctgaacttcctccgagagaacatctgcaagctcgaggacgagaacgccgagcacatgcccattggcttcgaggtcaccttcccctctctgattgacattgccaagaagctcaacattgaggtccccgaggacacccccgctctcaaggagatctacgctcgacgagacatcaagctcaccaagatccccatggaggttctccacaaggtccccaccactctcctccactctctcgagggtatgcccgatctcgagtgggagaagctgctcaagctgcagtgcaaggacggctctttcctcttctccccctcttccactgccttcgccctcatgcagaccaaggacgagaagtgtctccagtacctcaccaacattgtcaccaagttcaacggtggtgtccccaacgtctaccccgttgacctctttgagcacatctgggttgttgaccgactccagcgactcggtatcgcccgatacttcaagtccgagatcaaggactgtgtcgagtacatcaacaagtactggaccaagaacggtatctgctgggcccgaaacacccacgtccaggacattgacgacaccgccatgggcttccgagttctgcgagcccacggctacgatgtcacccccgatgtctttcgacagtttgagaaggacggcaagtttgtctgtttcgccggtcagtccacccaggccgtcaccggtatgttcaacgtctaccgagcttctcagatgctcttccccggtgagcgaatcctcgaggacgccaagaagttctcctacaactacctcaaggagaagcagtccaccaacgagctgctcgacaagtggatcattgccaaggatctgcccggtgaggttggctacgccctcgacatcccctggtacgcctctctgccccgactggagactcgatactacctcgagcagtacggtggtgaggacgatgtctggatcggtaagaccctgtaccgaatgggctacgtttccaacaacacctacctcgagatggccaagctcgactacaacaactacgttgccgtcctccagctcgagtggtacaccatccagcagtggtacgtcgacattggtatcgagaagttcgagtccgacaacatcaagtccgtccttgtctcctactacctcgctgctgcctccatcttcgagcccgagcgatccaaggagcgaattgcctgggccaagaccaccatcctcgtcgacaagatcacctccatcttcgactcctcccagtcctccaaggaagatatcaccgccttcattgacaagttccgaaacaagtcctcctccaagaagcactccatcaacggcgagccctggcacgaggtcatggttgctctcaagaaaactctccacggctttgccctcgacgctctgatgacccactctcaggacatccacccccagctccaccaggcctgggagatgtggctcaccaagctccaggacggtgttgatgtcactgctgagctcatggtccagatgatcaacatgaccgccggccgatgggtttccaaggagctcctcacccacccccagtaccagcgactctccactgtcaccaactctgtctgccacgacatcaccaagctccacaacttcaaggagaactccaccaccgtcgactccaaggtccaggagctggtccagctcgttttctccgacacccccgatgatctcgaccaggacatgaagcagaccttcctgactgtcatgaaaactttctactacaaggcctggtgcgaccccaacaccatcaacgaccacatctccaaggtctttgagattgtgatt

SEQ ID NO: 143 - DNA, 2352 bp, Stevia rebaudiana
atgaacctgtctctctgtatcgcctctcctctcctcaccaagtccaaccgacccgctgctctgtctgccatccacaccgcctccacctcccacggcggccagaccaaccccaccaacctcatcattgacaccaccaaggagcgaatccagaagcagttcaagaacgtcgagatctccgtttcctcctacgacaccgcctgggtcgccatggtcccctctcccaactcccccaagtctccctgcttccccgagtgtctcaactggctcatcaacaaccagctcaacgacggctcttggggtctggtcaaccacacccacaaccacaaccaccccctcctcaaggactctctctcttccactctcgcctgcattgttgctctcaagcgatggaacgttggcgaggaccagatcaacaagggtctgtctttcattgagtccaacctcgcctccgccaccgagaagtcccagccctcccccattggctttgatatcatcttccccggtctgctcgagtacgccaagaacctcgatatcaacctgctctccaagcagaccgacttctctctcatgctgcacaagcgagagctcgagcagaagcgatgccactccaacgagatggacggctacctggcctacatttccgagggtctgggtaacctctacgactggaacatggtcaagaagtaccagatgaagaacggttccgttttcaactccccctctgccaccgctgctgccttcatcaaccaccagaaccccggctgtctcaactacctcaactctctgctcgacaagtttggtaacgccgtccccactgtctacccccacgatctcttcatccgactctccatggtcgacaccattgagcgactcggtatttcccaccacttccgagtcgagatcaagaacgttctcgatgagacttaccgatgctgggttgagcgagatgagcagatcttcatggacgttgtcacctgtgctctggccttccgactcctccgaatcaacggttacgaggtttcccccgaccccctcgccgagatcaccaacgagctggctctcaaggacgagtacgccgccctcgagacttaccacgcttctcacattctgtaccaagaggatctgtcctccggcaagcagattctcaagtccgccgacttcctcaaggagatcatctccactgactccaaccgactctccaagctcatccacaaggaagtcgagaacgctctcaagttccccatcaacaccggtctggagcgaatcaacacccgacgaaacatccagctctacaacgtcgacaacacccgaattctcaagaccacctaccactcttccaacatctccaacaccgactacctgcgactcgccgtcgaggacttctacacctgccagtccatctaccgagaggagctcaagggtctggagcgatgggttgtcgagaacaagctcgaccagctcaagtttgcccgacaaaagactgcctactgctacttctccgttgctgccaccctctcttctcccgagctctccgacgcccgaatctcttgggccaagaacggtatcctgaccactgttgtcgacgacttctttgacattggtggcaccattgacgagctgaccaacctcatccagtgcgtcgagaagtggaacgtcgacgttgacaaggactgttgttccgagcacgtccgaatcctcttcctggctctcaaggacgccatctgctggatcggtgacgaggccttcaagtggcaggctcgagatgtcacttcccacgtcatccagacctggctcgagctcatgaactccatgctgcgagaggccatctggacccgagatgcctacgtccccaccctcaacgagtacatggagaacgcctacgtcagctttgctctcggtcccattgtcaagcccgccatctactttgtcggtcccaagctgtccgaggagattgtcgagtcctccgagtaccacaacctcttcaagctcatgtccacccagggccgactcctcaacgatatccactccttcaagcgagagttcaaggaaggtaagctcaacgccgttgctctgcacctgtccaacggtgagtccggcaaggtcgaggaagaggtcgtcgaggagatgatgatgatgatcaagaacaagcgaaaggagctcatgaagctcatcttcgaggagaacggctccattgtcccccgagcctgcaaggacgccttctggaacatgtgccacgtcctcaacttcttctacgccaacgacgacggtttcaccggcaacaccattctcgacaccgtcaaggacatcatctacaaccctctggttctggtcaacgagaacgaggagcagagg

SEQ ID NO: 144 - DNA, 2271 bp, Stevia rebaudiana
atgacctcccacggcggccagaccaaccccaccaacctcatcattgacaccaccaaggagcgaatccagaagcagttcaagaacgtcgagatctccgtttcctcctacgacaccgcctgggtcgccatggtcccctctcccaactcccccaagtctccctgcttccccgagtgtctcaactggctcatcaacaaccagctcaacgacggctcttggggtctggtcaaccacacccacaaccacaaccaccccctcctcaaggactctctctcttccactctcgcctgcattgttgctctcaagcgatggaacgttggcgaggaccagatcaacaagggtctgtctttcattgagtccaacctcgcctccgccaccgagaagtcccagccctcccccattggctttgatatcatcttccccggtctgctcgagtacgccaagaacctcgatatcaacctgctctccaagcagaccgacttctctctcatgctgcacaagcgagagctcgagcagaagcgatgccactccaacgagatggacggctacctggcctacatttccgagggtctgggtaacctctacgactggaacatggtcaagaagtaccagatgaagaacggttccgttttcaactccccctctgccaccgctgctgccttcatcaaccaccagaaccccggctgtctcaactacctcaactctctgctcgacaagtttggtaacgccgtccccactgtctacccccacgatctcttcatccgactctccatggtcgacaccattgagcgactcggtatttcccaccacttccgagtcgagatcaagaacgttctcgatgagacttaccgatgctgggttgagcgagatgagcagatcttcatggacgttgtcacctgtgctctggccttccgactcctccgaatcaacggttacgaggtttcccccgaccccctcgccgagatcaccaacgagctggctctcaaggacgagtacgccgccctcgagacttaccacgcttctcacattctgtaccaagaggatctgtcctccggcaagcagattctcaagtccgccgacttcctcaaggagatcatctccactgactccaaccgactctccaagctcatccacaaggaagtcgagaacgctctcaagttccccatcaacaccggtctggagcgaatcaacacccgacgaaacatccagctctacaacgtcgacaacacccgaattctcaagaccacctaccactcttccaacatctccaacaccgactacctgcgactcgccgtcgaggacttctacacctgccagtccatctaccgagaggagctcaagggtctggagcgatgggttgtcgagaacaagctcgaccagctcaagtttgcccgacaaaagactgcctactgctacttctccgttgctgccaccctctcttctcccgagctctccgacgcccgaatctcttgggccaagaacggtatcctgaccactgttgtcgacgacttctttgacattggtggcaccattgacgagctgaccaacctcatccagtgcgtcgagaagtggaacgtcgacgttgacaaggactgttgttccgagcacgtccgaatcctcttcctggctctcaaggacgccatctgctggatcggtgacgaggccttcaagtggcaggctcgagatgtcacttcccacgtcatccagacctggctcgagctcatgaactccatgctgcgagaggccatctggacccgagatgcctacgtccccaccctcaacgagtacatggagaacgcctacgtcagctttgctctcggtcccattgtcaagcccgccatctactttgtcggtcccaagctgtccgaggagattgtcgagtcctccgagtaccacaacctcttcaagctcatgtccacccagggccgactcctcaacgatatccactccttcaagcgagagttcaaggaaggtaagctcaacgccgttgctctgcacctgtccaacggtgagtccggcaaggtcgaggaagaggtcgtcgaggagatgatgatgatgatcaagaacaagcgaaaggagctcatgaagctcatcttcgaggagaacggctccattgtcccccgagcctgcaaggacgccttctggaacatgtgccacgtcctcaacttcttctacgccaacgacgacggtttcaccggcaacaccattctcgacaccgtcaaggacatcatctacaaccctctggttctggtcaacgagaacgaggagcagagg

SEQ ID NO: 145 - DNA, 1539 bp, Stevia rebaudiana
atggacgccgtcactggtctgctcaccgtccccgccactgccatcaccatcggtggtactgccgttgctctggccgttgctctcatcttctggtacctcaagtcctacacctctgcccgacgatcccagtccaaccacctcccccgagtccccgaggtccccggtgtccccctgctcggtaacctgctccagctcaaggagaagaagccctacatgaccttcacccgatgggctgccacctacggccccatctactccatcaagactggtgccacctccatggttgttgtctcttccaacgagattgctaaagaggctctcgtcacccgattccagtccatctccacccgaaacctctccaaggctctcaaggttctgaccgccgacaagaccatggttgccatgtccgactacgacgactaccacaagaccgtcaagcgacacattctcaccgccgttctcggccccaacgcccagaagaagcaccgaatccaccgagacatcatgatggacaacatctccacccagctccacgagtttgtcaagaacaaccccgagcaggaagaggttgatctccgaaagatcttccagtccgagctcttcggtctggccatgcgacaggctctgggcaaggatgtcgagtctctctacgtcgaggatctcaagatcaccatgaaccgagatgagatcttccaggttctggttgtcgaccccatgatgggtgccattgatgtcgactggcgagacttcttcccctacctcaagtgggtccccaacaagaagtttgagaacaccatccagcagatgtacatccgacgagaggctgtcatgaagtctctcatcaaggagaacaagaagcgaattgcctccggtgagaagctcaactcctacattgactacctgctctccgaggcccagaccctcaccgaccagcagctgctcatgtctctgtgggagcccatcattgagtcctccgacaccaccatggtcaccaccgagtgggccatgtacgagctcgccaagaaccccaagctccaggaccgactctaccgagacatcaagtctgtctgtggctccgagaagatcaccgaggagcacctgtcccagctcccctacatcactgccatcttccacgagactctccgacgacactctcccgtccccatcatccctctccgacacgtccacgaggacaccgttctgggtggctaccacgtccccgccggtaccgagctcgctgtcaacatctacggctgcaacatggacaagaacgtctgggagaaccccgaggagtggaaccccgagcgattcatgaaggagaacgagactattgacttccagaaaaccatggcctttggtggtggcaagcgagtctgcgccggctctctccaggctctgctgaccgcctccattggtattggccgaatggtccaggagttcgagtggaagctcaaggacatgacccaggaagaggtcaacaccattggcctcaccacccagatgctccgacctctccgagccatcatcaagccccgaata

SEQ ID NO: 146 - DNA, 1566 bp, Stevia rebaudiana
atgggtctgttccccctcgaggactcctacgctctggtctttgagggcctcgccatcaccctcgccctctactacctgctctccttcatctacaagacctccaagaaaacctgcactcctcccaaggcctccggtgagcaccccatcaccggccacctcaacctgctctccggctcttccggcctcccccacctcgccctcgcctctctggctgaccgatgtggtcccatcttcaccatccgactcggtatccgacgagtcctcgttgtctccaactgggagattgccaaggagatcttcaccacccacgatctcattgtctccaaccgacccaagtacctggctgccaagattctcggtttcaactacgtttccttctcctttgccccctacggcccctactgggtcggtatccgaaagatcattgccaccaagctcatgtcctcttctcgactccagaagctccagttcgtccgagtctttgagctcgagaactccatgaagtccatccgagagtcttggaaggagaagaaggacgaggaaggcaaggttctggtcgagatgaagaagtggttctgggagctcaacatgaacattgttctgcgaactgttgctggtaagcagtacaccggtaccgtcgacgacgccgatgccaagcgaatctccgagctcttccgagagtggttccactacaccggccgatttgttgtcggtgacgccttccccttcctcggctggctcgatctcggtggctacaagaaaaccatggagctcgtcgcctcccgactcgactccatggtcagcaagtggctcgacgagcaccgaaagaagcaggccaacgacgacaagaaagaggacatggacttcatggacatcatgatctccatgaccgaggccaactctcccctcgagggttacggtaccgacaccatcatcaagaccacctgcatgaccctcattgtctccggtgtcgacaccacctccattgtcctgacctgggctctgtctctgctgctcaacaaccgagacactctcaagaaggcccaggaagagctcgacatgtgtgtcggcaagggccgacaggtcaacgagtccgatctggtcaacctcatctacctcgaggctgttctcaaggaagctctgcgactctaccccgctgccttcctcggtggtccccgagccttcctcgaggactgcactgttgccggctaccgaatccccaagggtacctgtctgctcatcaacatgtggaagctccaccgagatcccaacatctggtccgacccctgcgagttcaagcccgagcgattcctgacccccaaccagaaggacgttgatgtcattggtatggacttcgagctcatccccttcggtgccggccgacgatactgccccggtacccgactcgccctccagatgctgcacattgttctcgccactctgctccagaactttgagatgtccacccccaacgacgcccccgtcgacatgactgcttccgtcggtatgaccaacgccaaggcttctcctctcgaggtcctcctgtctccccgagtcaagtggtca

SEQ ID NO: 147 - DNA, 1443 bp, Stevia rebaudiana
atggacgccatggccaccaccgagaagaagccccacgtcatcttcatccccttccccgcccagtcccacatcaaggccatgctcaagctcgcccagctcctccaccacaagggcctccagatcacctttgtcaacaccgacttcatccacaaccagttcctcgagtcctccggcccccactgtctggacggtgctcccggtttccgatttgagactatccccgatggtgtctcccactcccccgaggcctccatccccatccgagagtctctgctccgatccattgagactaacttcctcgaccgattcattgatctcgtcaccaagctccccgatcctcccacctgtatcatctccgacggtttcctgtccgttttcaccattgatgctgccaagaagctcggtatccccgtcatgatgtactggactctggctgcctgtggtttcatgggtttctaccacatccactctctgatcgagaagggctttgctcctctcaaggacgcctcctacctcaccaacggttacctcgacaccgtcattgactgggtccccggtatggagggtatccgactcaaggacttccccctcgactggtccaccgacctcaacgacaaggttctcatgttcaccaccgaggctccccagcgatcccacaaggtttcccaccacatcttccacaccttcgacgagctcgagccctccatcatcaagactctgtctctgcgatacaaccacatctacaccattggccccctccagctcctcctcgaccagatccccgaggagaagaagcagaccggtatcacctctctgcacggctactctctcgtcaaggaagagcccgagtgcttccagtggctccagtccaaggagcccaactccgttgtctacgtcaactttggctccaccaccgtcatgtctctcgaggacatgaccgagtttggctggggtctggccaactccaaccactacttcctgtggatcatccgatccaacctcgtcattggcgagaacgccgttctgcctcccgagctcgaggagcacatcaagaagcgaggcttcattgcctcttggtgctcccaggagaaggttctcaagcacccctccgtcggtggtttcctgacccactgcggctggggctccaccattgagtctctgtccgctggtgtccccatgatctgctggccctactcctgggaccagctcaccaactgccgatacatctgcaaggagtgggaggttggtctggagatgggtaccaaggtcaagcgagatgaggtcaagcgactcgtccaggagctcatgggcgagggtggtcacaagatgcgaaacaaggccaaggactggaaggagaaggcccgaattgccattgcccccaacggctcttcttctctcaacattgacaagatggtcaaggagatcactgttctcgctcgaaac

SEQ ID NO: 148 - DNA, 1380 bp, Stevia rebaudiana
atggccgagcagcagaagatcaagaagtctccccacgttctgctcatccccttccctctgcagggccacatcaaccccttcatccagttcggcaagcgactcatctccaagggtgtcaagaccactctggtcaccaccatccacaccctcaactccactctcaaccactccaacaccaccaccacctccatcgagatccaggccatctccgacggctgtgacgagggtggtttcatgtctgctggtgagtcttacctcgagactttcaagcaggtcggttccaagtctctggctgacctcatcaagaagctccagtccgagggtaccaccattgacgccatcatctacgactccatgaccgagtgggttctcgatgtcgccatcgagtttggtattgacggtggctccttcttcacccaggcctgtgtcgtcaactctctctactaccacgtccacaagggtctgatctctctgcccctcggcgagactgtctccgtccccggtttccccgttctgcagcgatgggagactcctctcattctccagaaccacgagcagatccagtccccctggtcccagatgctcttcggccagttcgccaacattgaccaggcccgatgggttttcaccaactccttctacaagctcgaggaagaggtcattgagtggacccgaaagatctggaacctcaaggtcattggccccaccctcccctccatgtacctcgacaagcgactcgatgacgacaaggacaacggtttcaacctctacaaggccaaccaccacgagtgcatgaactggctcgacgacaagcccaaggagtccgttgtctacgttgcctttggctctctggtcaagcacggccccgagcaggttgaggagatcacccgagctctgattgactccgatgtcaacttcctgtgggtcatcaagcacaaggaagagggtaagctccccgagaacctgtccgaggtcatcaagaccggcaagggcctcattgttgcctggtgcaagcagctcgacgttctcgcccacgagtccgtcggctgctttgtcacccactgcggtttcaactccaccctcgaggctatctctctcggtgtccccgttgttgccatgccccagttctccgaccagaccaccaacgccaagctcctcgatgagattctcggtgtcggtgtccgagtcaaggctgacgagaacggtattgtccgacgaggtaacctggcttcttgtatcaagatgatcatggaggaagagcgaggtgtcatcatccgaaagaacgccgtcaagtggaaggatctggccaaggttgctgtccacgagggtggctcttccgacaacgacattgtcgagtttgtctccgagctcatcaaggcc

SEQ ID NO: 149 - DNA, 1374 bp, Stevia rebaudiana
atggagaacaagaccgagactaccgtccgacgacgacgacgaatcattctcttccccgtccccttccagggccacatcaaccccattctgcagctcgccaacgttctgtactccaagggcttctccatcaccatcttccacaccaacttcaacaagcccaagacctccaactacccccacttcactttccgattcatcctcgacaacgacccccaggacgagcgaatctccaacctgcccacccacggtcctctggctggtatgcgaatccccatcatcaacgagcacggtgctgacgagctccgacgagagctcgagctgctcatgctcgcctccgaagaggacgaggaagtctcctgtctgatcaccgatgctctgtggtactttgcccagtccgtcgccgactctctcaacctgcgacgactcgttctcatgacctcctctctgttcaacttccacgcccacgtttctctgccccagtttgacgagctcggttacctcgaccccgatgacaagacccgactcgaggagcaggcttccggtttccccatgctcaaggtcaaggacatcaagtccgcctactccaactggcagattctcaaggagattctcggcaagatgatcaagcagaccaaggcctcctccggtgtcatctggaactccttcaaggagctcgaggagtccgagctcgagactgtcatccgagagatccccgctccctctttcctcatccccctgcccaagcacctcaccgcttcctcctcttctctgctcgaccacgaccgaaccgtctttcagtggctcgaccagcagcccccttcctccgtcctctacgtttccttcggctccacctccgaggtcgacgagaaggacttcctcgagattgctcgaggcctcgttgactccaagcagtccttcctgtgggttgtccgacccggctttgtcaagggctccacctgggttgagcccctgcccgatggtttcctcggtgagcgaggccgaattgtcaagtgggtcccccagcaggaagttctggcccacggtgccattggtgccttctggacccactccggctggaactccactctcgagtccgtctgcgagggtgtccccatgatcttctccgactttggcctcgaccagcccctcaacgcccgatacatgtccgatgttctcaaggtcggtgtctacctcgagaacggctgggagcgaggtgagattgccaacgccatccgacgagtcatggtcgacgaggaaggtgagtacatccgacagaacgcccgagtcctcaagcagaaggccgatgtctctctcatgaagggtggttcttcttacgagtctctcgagtctctcgtttcctacatctcttctttg

SEQ ID NO: 150 - DNA, 2130 bp, Stevia rebaudiana
atgcagtccgactccgtcaaggtcagccccttcgatcttgtctccgccgccatgaacggcaaggccatggagaagctcaacgcctccgagtccgaggaccccaccaccctccccgctctcaagatgctcgtcgagaaccgagagctcctcaccctcttcaccacctccttcgccgttctcattggctgtctggtctttctcatgtggcgacgatcttcctccaagaagctcgtccaggaccccgtcccccaggtcattgttgtcaagaagaaggagaaggagtccgaggtcgacgacggcaagaagaaggtttccatcttctacggtactcagaccggtactgccgagggtttcgccaaggctctcgtcgaggaagccaaggtccgatacgaaaagacctccttcaaggtcatcgatctcgatgactacgctgctgacgacgacgagtacgaggagaagctcaagaaggagtctctcgccttcttcttcctggccacctacggtgacggtgagcccactgacaacgccgccaacttctacaagtggttcaccgagggtgacgacaagggcgagtggctcaagaagctccagtacggtgtctttggcctcggtaaccgacagtacgagcacttcaacaagattgccattgttgtcgacgacaagctgaccgagatgggcgccaagcgactcgttcccgtcggcctcggtgatgatgaccagtgtatcgaggacgacttcaccgcctggaaggagctcgtctggcccgagctcgaccagctgctgcgagatgaggacgacacttccgtcaccactccctacaccgctgctgttctcgagtaccgagttgtctaccacgacaagcccgctgactcctacgccgaggaccagacccacaccaacggccacgttgtccacgacgcccagcacccctctcgatccaacgttgccttcaagaaggagctccacacctcccagtccgaccgatcttgcacccacctcgagtttgacatctcccacactggtctgtcttacgaaaccggcgaccacgtcggtgtctactccgagaacctctccgaggttgtcgacgaggctctcaagctgctcggtctgtctcccgacacctacttctccgtccacgccgataaagaggacggcacccccatcggtggtgcttctctgcctcctccctttcccccttgcactctgcgagatgctctgacccgatacgccgacgttctctcttctcccaagaaggttgctctgctggccctcgccgcccacgcctccgacccctccgaggccgaccgactcaagttcctcgcctctcccgctggtaaggacgagtacgcccagtggatcgtcgccaaccagcgatctctgctcgaggtcatgcagtccttcccctctgccaagccccctctgggtgttttcttcgccgccgttgctccccgactccagccccgatactactccatctcttcttctcccaagatgtcccccaaccgaatccacgtcacctgtgctctggtctacgaaaccacccccgccggccgaatccaccgaggcctctgttccacctggatgaagaacgccgtccccctgaccgagtcccccgactgctcccaggcttccatcttcgtccgaacctccaacttccgactccccgttgaccccaaggtccccgtcatcatgatcggtcccggtaccggtctggcccccttccgaggcttcctgcaggagcgactcgctctcaaggagtccggcaccgagctcggttcctccatcttcttctttggctgccgaaaccgaaaggtcgacttcatctacgaggacgagctcaacaactttgtcgagactggtgctctctccgagctcattgttgccttctcccgagagggtaccgccaaggagtacgtccagcacaagatgtcccagaaggcctccgacatctggaagctcctctccgagggtgcctacctctacgtctgcggtgacgccaagggtatggccaaggatgtccaccgaaccctgcacaccattgtccaggagcagggctctctcgactcttccaaggccgagctctacgtcaagaacctccagatgtccggccgatacctccgagatgtgtgg

SEQ ID NO: 151 - DNA, 2397 bp, Lactuca sativa
atgaaaaccatgatctcttctcccatccccgctttccacccccgattctctcctgctgctggctctcgacgactctcccccatcctcccctcttccggctccgtcgttctgaccggctccaagacccagtgcaaggctgtctccaagtcccccacccaggagtacttcgacgttctgcagaagaacggtctgcccttcatcaactggcagaacgacgttgtcgaggacgagctcgacaaggagaagaagattctctaccccaacgacgagatcaagggctttgtcgagcgaatcaaggtcatgctcggctccatggacgagggtgagatcactgtctccgcctacgacaccgcctgggttgctctcgtccaggacattgacggcaacggtcgacccgagttcccctcctctctcgagtggatcgtcaagaaccagctgtccgacggctcttggggtgaccacctcatcttctccgcccacgaccgaatcatcaacaccctcgcctgtgtcattgctctgacctcttggaacgtccaccccggcaagtgccagaagggtctgaagttcctcaacgacaacatctccaagctcgaagaggagaaccccgagcacatgcccattggtttcgaggttgccttcccctctctcattgacattgcccgaaagctcgatatccaggtccccgaggactcccctgctctcaaggagatctacgcccgacgaaacctcaagctcaccaagatccccaagtctctcatgcacaaggtccccaccactctgctgcactctctcgagggtatgcccgatctcgagtgggagaagctgctcaagctccagtgcaaggacggttccttcctcttctccccctcctccaccgccttcgccctcatgcagaccaaggaccagaagtgtctgcagtacctcaccgacgccgtcaccaagttcaacggtggtgtccccaacgtctaccccgtcgacctctttgagcacatctgggttgtcgaccgactgcagcgactcggtatctctcgatactttgactccgagatcaaggactgtgtcgactacatctaccgatactggaccaaggacggtatctgctgggccaagaactccaacgtccaggacattgacgacaccgccatgggcttccgagttctgcgaatgcacggctacaaggtcaccactgacgttttccgacagttcgagaaggacggcaagttcgtctgtttccccggccagaccacccaggccgtcaccggtatgttcaacctcttccgagcttcccaggttctcttccccgacgagaagattctcgaggacgccaagaagttctcctacaactacctcaaggagaagcagtccaccaacgagctcctcgacaagtggatcattgccaaggatctgcccggtgaggtcgagtacgccctcgatgtcccctggtacgcctctctgcctcgactcgagactcgattctacctcgagcagtacggtggcgaggacgatgtctggatcggtaagactctctaccgaatgggtaacgtttccaacaacacctacctcgagatggccaagctcgactacaacaactgtctggccatccaccacctcgagtggaacaccatgcagcagtggtacgtcgactttggtatggagcgattcggtacctccgatatcacctctctgcttgtctcttactacctcgccgctgcctccgtctttgagcccgagcgatccaaggagcgaattgcctgggccaagaccaccactctggtcgacaccatctcctccttcttccactctctcaagatctccaacgagcaccgacgagagtttgtcgaggagttccgaaacatctccaactccatccaccacgccaagtacggcaagccctggcacggtctgatggttgctctcaagggtactctgcacgagattgctctcgatgttctcatgacccaccgacgagacatccacccccagctccaccacgcctgggagatgtggctcatgcgatggcagcagggtgttgacgccaccgagggccaggctgagctcattgtccagaccatcaacatgaccgccggtcgatgggtttccaacgagctgctcgcccacccccagtaccgactcctctcctccgtcatcaacaacatctgccacgagatctaccacaaccgaacctgcatggaggtcaactccaccaccatctccacctccattgactccaagatgcaggagctcgtccagctggttctctccgactctctcgatgatctcgaccaggatctcaagcagaccttcctgaccgttgccaagaccttctactacaaggcctactgcgaccccgagactatcaacgtccacatctccaaggtcatgtttgagactattatt

SEQ ID NO: 152 - DNA, 2271 bp, Lactuca sativa
atgtgcaaggctgtctccaagtcccccacccaggagtacttcgacgttctgcagaagaacggtctgcccttcatcaactggcagaacgacgttgtcgaggacgagctcgacaaggagaagaagattctctaccccaacgacgagatcaagggctttgtcgagcgaatcaaggtcatgctcggctccatggacgagggtgagatcactgtctccgcctacgacaccgcctgggttgctctcgtccaggacattgacggcaacggtcgacccgagttcccctcctctctcgagtggatcgtcaagaaccagctgtccgacggctcttggggtgaccacctcatcttctccgcccacgaccgaatcatcaacaccctcgcctgtgtcattgctctgacctcttggaacgtccaccccggcaagtgccagaagggtctgaagttcctcaacgacaacatctccaagctcgaagaggagaaccccgagcacatgcccattggtttcgaggttgccttcccctctctcattgacattgcccgaaagctcgatatccaggtccccgaggactcccctgctctcaaggagatctacgcccgacgaaacctcaagctcaccaagatccccaagtctctcatgcacaaggtccccaccactctgctgcactctctcgagggtatgcccgatctcgagtgggagaagctgctcaagctccagtgcaaggacggttccttcctcttctccccctcctccaccgccttcgccctcatgcagaccaaggaccagaagtgtctgcagtacctcaccgacgccgtcaccaagttcaacggtggtgtccccaacgtctaccccgtcgacctctttgagcacatctgggttgtcgaccgactgcagcgactcggtatctctcgatactttgactccgagatcaaggactgtgtcgactacatctaccgatactggaccaaggacggtatctgctgggccaagaactccaacgtccaggacattgacgacaccgccatgggcttccgagttctgcgaatgcacggctacaaggtcaccactgacgttttccgacagttcgagaaggacggcaagttcgtctgtttccccggccagaccacccaggccgtcaccggtatgttcaacctcttccgagcttcccaggttctcttccccgacgagaagattctcgaggacgccaagaagttctcctacaactacctcaaggagaagcagtccaccaacgagctcctcgacaagtggatcattgccaaggatctgcccggtgaggtcgagtacgccctcgatgtcccctggtacgcctctctgcctcgactcgagactcgattctacctcgagcagtacggtggcgaggacgatgtctggatcggtaagactctctaccgaatgggtaacgtttccaacaacacctacctcgagatggccaagctcgactacaacaactgtctggccatccaccacctcgagtggaacaccatgcagcagtggtacgtcgactttggtatggagcgattcggtacctccgatatcacctctctgcttgtctcttactacctcgccgctgcctccgtctttgagcccgagcgatccaaggagcgaattgcctgggccaagaccaccactctggtcgacaccatctcctccttcttccactctctcaagatctccaacgagcaccgacgagagtttgtcgaggagttccgaaacatctccaactccatccaccacgccaagtacggcaagccctggcacggtctgatggttgctctcaagggtactctgcacgagattgctctcgatgttctcatgacccaccgacgagacatccacccccagctccaccacgcctgggagatgtggctcatgcgatggcagcagggtgttgacgccaccgagggccaggctgagctcattgtccagaccatcaacatgaccgccggtcgatgggtttccaacgagctgctcgcccacccccagtaccgactcctctcctccgtcatcaacaacatctgccacgagatctaccacaaccgaacctgcatggaggtcaactccaccaccatctccacctccattgactccaagatgcaggagctcgtccagctggttctctccgactctctcgatgatctcgaccaggatctcaagcagaccttcctgaccgttgccaagaccttctactacaaggcctactgcgaccccgagactatcaacgtccacatctccaaggtcatgtttgagactattatt

SEQ ID NO: 153 - DNA, 2283 bp, Picea glauca
atgaagatgtccaagtccgtcgaggtccagcactgcgccgtccagttcctgtcctccaccaccgaccagattgagatccgagagcgaaacctccagatctccaccgaggccatgaagatgaagtcttggatcgagactgtcaagtacattctgcagtccatggaggacggtgagatcaccatctctgcttacgacactgcctggatcgccctcgtccccgctctcaacggctcttccgagccccagttcccctcttctctgcagtggctcatcaacaaccagctccaggacggctcttggggtgaccccctcatgttcctcatccgagatcgaatcatcaacaccctcgcctgtgtccttgctctcaagacctggaacatccactctctcggtgtcaacaagggtctgtccttcctccagacctacatccccaagatgaacgacgagcacgacgcccacacccccgttggctttgagattgtctttcctgctctcatggaggacgccaagatcatggagctcgatctgccctacgacgccgagttcctccagaagatctacgacgagcgagatctcaagatgaagcgaatccccatgaaggttctgcacgagttcccctccactctgctccactctctcgagggcctccgagacaaggtcaactgggaggagctcctcaagctccagtccaagaacggttccttcctcttctcccccgcctccaccgcctgtgctctggcccagacctccgacaccaactgtctgcgatacctcaacgagatcaccaagaagtacgacggtggtgctcccaacgtctaccccgttgacctctttgagcgactctggaccgtcgaccgaattgagcgactcggtattgcccgatactttgagtccgagatcaccgactctctcgagtacgtctaccgatactggaccaaccagggtattggctgggcccgagactcccccgtcaaggacgttgacgacacctccatggccttccgactgctgcgatcccacggcttcgatgtcactgccgaggccttcaaccacttcaagcaggacgaccagttcttctgcttctttggccagaccaagcagaccgtcaccggtatgtacaacctctaccgagcctcccagttctccttccccggtgagtccatcctcgaggaagctcgagtctttaccaagaacttcctcgaggagaagcgagctgagaagcagctgcgagacaagtggatcattgccaagggcctcaaggaagaggtcgagtacgctctcaagttcccctggtacgcctctcagcctcgaattgacacccgaatgtacatcaaccagtaccgagttgatgatgtctggatcggtaaggctctctaccgaatgcccattgtcaacaacaagacctacattgagctcgccaaggctgacttcaacatctgccagtccatccaccgaaccgagctccacggtatcatccgatggtaccgagagtccggtctggacgagctcggtctgcgacaggaccagattgtcaagtcttacttcctcgccgccattgccatctacgagcccgacatggcctccgcccgactcgcctgggccaagtctgctgttctcatggctgccatccgaatcttcttctccggtgagaactgctttgcccaccaccgacgacagttcctcgacgccttcacccgatgggacggccgagccatgcgagactcccccaactccgccaagcgactcttctcttgtctcttccgaatggtcaacctcttctccgtcgacggtgttgttgcccagggccgagacatctccggtgatctgcgacaccgatgggagcactggctcgcctccgaggccgaggatctgaccgacgcccaggaccacgagaagctcggtaccgaggctgagattgttgttctgaccgctgctttcctcggccgagagactatctcccccgatctcatctcccaccccgacttctcctccatcatgaaggtcaccaacaccgtctgctctctgctgcgacgaattgccacctacaaggaagagggctgcgactccccctccggtactgaagaggacgaccgactcaagcgacgagctgaagagggtatgggccaccttgtccgagccgtctaccgacaccagtactcccccgtcccctctggtgtcaagcgactctgtctggttgtcggcaagtctttctactacgccgcccactgcaacaacgaggaagtcggcaaccacgttgagactgttctcttccagcccgtgtat

SEQ ID NO: 154 - DNA, 1548 bp, Bradyrhizobium japonicum
atgaacgccctctccgagcacattctgtccgagctccgacgactcctctccgagatgtccgacggtggttccgtcggcccctccgtctacgacaccgcccaggctctgcgattccacggtaacgtcaccggccgacaggacgcctacgcctggctcattgcccagcagcaggctgacggtggctggggttccgccgacttccctctcttccgacacgcccccacctgggctgctctgctcgctctgcagcgagccgaccccctccccggtgctgccgacgccgtccagaccgccacccgattcctccagcgacagcccgacccctacgcccacgccgtccccgaggacgcccccattggtgccgagctcatcctcccccagttctgcggtgaggctgcttctctgctcggtggtgttgccttcccccgacaccccgctctgctccccctccgacaggcctgtctggtcaagctcggtgccgtcgccatgctcccctccggccaccctctgctccactcttgggaggcctggggtacttctcccaccactgcctgccccgacgacgacggctccatcggtatctctcccgctgccaccgccgcctggcgagcccaggctgtcacccgaggctccactccccaggtcggccgagccgatgcctacctccagatggcctctcgagccacccgatccggtatcgagggtgttttccccaacgtctggcccatcaacgtctttgagccctgctggtccctctacaccctccacctcgccggcctcttcgcccaccccgctctcgccgaggctgtccgagtcatcgtcgcccagctcgacgcccgactcggtgtccacggtcttggccccgctctgcactttgctgccgacgccgacgacaccgccgttgctctctgtgttctgcacctcgccggccgagatcccgccgtcgatgctctgcgacactttgagattggtgagctcttcgtcaccttccccggtgagcgaaacgcctccgtttccaccaacatccacgccctccacgccctccgactcctcggcaagcccgctgccggtgcctccgcctacgtcgaggccaaccgaaacccccacggtctgtgggacaacgagaagtggcacgtcagctggctctaccccaccgcccacgccgttgctgctctcgcccagggcaagccccagtggcgagatgagcgagctctggctgctctgctccaggcccagcgagatgacggtggctggggtgctggccgaggctccaccttcgaggagactgcctacgccctcttcgccctccacgtcatggacggctctgaagaggccaccggccgacgacgaatcgcccaggttgttgcccgagctctcgagtggatgctcgcccgacacgccgcccacggtctgccccagacccctctgtggatcggtaaggagctctactgccccacccgagttgtccgagttgccgagctcgccggtctgtggctcgctctgcgatggggccgacgagtcctcgccgagggtgccggtgctgcccca

SEQ ID NO: 155 - DNA, 2364 bp, Lactuca sativa
atgaacattgcccagatcacctcttctgccatgctcgtcccctcttcccacattccccaccgatcttgggtcgtcaactgctgcatggtccagtacaacccctccggtctgcgaaccgcttcttcccaggctggccaggtcaaccccactgtcatgaccctcgatgtcaccaaggagcgaatccgaaagctcttcaacaacgttgaggtttccgtttcctcttacgacaccgcctgggttgccatggtcccctctcccaactcccccaagtctccttgtttccccgactgtctcaactggctcctcgacaaccagctcgacgacggctcttggggtctgctcccccaccagtctcctctgatcaaggacaccctctcttccactctggcctgtgtccttgctctcaagcgatggaacgtcggtaaggaccagatcaacaagggtctgcactacattgagtccaactttgcctccgtcaccgacaagaaccaggcttctccctttggcttcgacatcatcttccccggtatgctcgagtacgccaaggacctcgatatcaagctgcccctcaaccagacccacctgtccgtcatgctccacgagcgagagctcgagctccgacgatgccactccaacggccgagaggcctacctcgcctacatctccgagggtcttggtaacctcaacgactggaacatggtcatgaagtaccagatgaagaacggctctctgttcaactccccctctgccaccgcctccgttctcatccaccaccagaacgccggctgtctgcactacctgacctctctgctcgacaagtttggtaacgctgtccccaccgtctaccccattgatctgtacgtccgactctccatggtcgacaccctcgagcgactcggtatcaagcgacacttcatggtcgagatccagaacgttctcgacgagacttaccgatgctgggtccagggtgatgtccagatcttcatggacgttgtcacctgtgctctggccttccgagttctgcgatccaacggttacgaggtttcttccgaccctctggccaagatcaccaaggaaggtgactacatgaactcccccgagaagcccttcaaggacgtctacacctctctcgaggtctacaaggcctcccagatcatctaccaagaggagctcgccttccgagagcagaacctgacctcctacctgccctcttccaacaagctctccaactacattctcaaagaggtcgacgacgctctcaagttccccttcaacggctctctcgagcgaatgtccacccgacgaaacattgagcactacaacctcaaccacacccgaattctcaagaccacctactcctcttccaacatctccaacaaggactacctcaagctcgccgtccaggacttcaacgagtgccagtccatctactgtgaggagctcaaggacctcgagcgatgggttgtcgagaaccgactcgacaagctcaagtttgcccgacaaaagactgcttactgctacttctccgctgcctctttcctctcctcccccgatctgtccgacgcccgaatctcttgggccaagtcctccattctgaccaccgtcattgacgacttcttcgatgtcggtggctccatggacgagctcgtcaactttgtccacatcattgagaagtggaacgtcaacgtcgagaacgactgctgctccgaagaggtcggtgttctcttcctggctctcaaggacgccgtctgctggatcggtgacaaggccttcaagatccaggagcgaaacatcacctcccacgtcattgagatctggctcgatctcgtcaagtccatgctgcgagaggccatctgggccaaggacggctccatccccaccatcaacgagtacatggagaacggctacgtttcctttgctctcggtcccattgttctgcccactctctacttcctcggtgtcaagctgtccgaggaagttgtccagtcctccgagtaccacaagctctacgaggtcatgtccacccagggccgactcatgaacgacatccactccttcaagcgagagaagaaggctggtaagctcaacgccgtcgccctctacatgtccgacggcaagtccggctccgtcgaagaggaagttgtcgaggagatgaagatcctcaccaagtcccagcgaaaggagatgatgaagctcgttctcgagactaagggctccgtcgtcccccgagtctgcaaggatgttttctggaacatgtgcaacgttctcaacctcttctacgccaccgacgacggtttcactggtaacgccattctcgatgttgtcaaggagatcatctacgagcccgtttcccacgagctcatc

SEQ ID NO: 156 - DNA, 2250 bp, Lactuca sativa
atggcttcttcccaggctggccaggtcaaccccactgtcatgaccctcgatgtcaccaaggagcgaatccgaaagctcttcaacaacgttgaggtttccgtttcctcttacgacaccgcctgggttgccatggtcccctctcccaactcccccaagtctccttgtttccccgactgtctcaactggctcctcgacaaccagctcgacgacggctcttggggtctgctcccccaccagtctcctctgatcaaggacaccctctcttccactctggcctgtgtccttgctctcaagcgatggaacgtcggtaaggaccagatcaacaagggtctgcactacattgagtccaactttgcctccgtcaccgacaagaaccaggcttctccctttggcttcgacatcatcttccccggtatgctcgagtacgccaaggacctcgatatcaagctgcccctcaaccagacccacctgtccgtcatgctccacgagcgagagctcgagctccgacgatgccactccaacggccgagaggcctacctcgcctacatctccgagggtcttggtaacctcaacgactggaacatggtcatgaagtaccagatgaagaacggctctctgttcaactccccctctgccaccgcctccgttctcatccaccaccagaacgccggctgtctgcactacctgacctctctgctcgacaagtttggtaacgctgtccccaccgtctaccccattgatctgtacgtccgactctccatggtcgacaccctcgagcgactcggtatcaagcgacacttcatggtcgagatccagaacgttctcgacgagacttaccgatgctgggtccagggtgatgtccagatcttcatggacgttgtcacctgtgctctggccttccgagttctgcgatccaacggttacgaggtttcttccgaccctctggccaagatcaccaaggaaggtgactacatgaactcccccgagaagcccttcaaggacgtctacacctctctcgaggtctacaaggcctcccagatcatctaccaagaggagctcgccttccgagagcagaacctgacctcctacctgccctcttccaacaagctctccaactacattctcaaagaggtcgacgacgctctcaagttccccttcaacggctctctcgagcgaatgtccacccgacgaaacattgagcactacaacctcaaccacacccgaattctcaagaccacctactcctcttccaacatctccaacaaggactacctcaagctcgccgtccaggacttcaacgagtgccagtccatctactgtgaggagctcaaggacctcgagcgatgggttgtcgagaaccgactcgacaagctcaagtttgcccgacaaaagactgcttactgctacttctccgctgcctctttcctctcctcccccgatctgtccgacgcccgaatctcttgggccaagtcctccattctgaccaccgtcattgacgacttcttcgatgtcggtggctccatggacgagctcgtcaactttgtccacatcattgagaagtggaacgtcaacgtcgagaacgactgctgctccgaagaggtcggtgttctcttcctggctctcaaggacgccgtctgctggatcggtgacaaggccttcaagatccaggagcgaaacatcacctcccacgtcattgagatctggctcgatctcgtcaagtccatgctgcgagaggccatctgggccaaggacggctccatccccaccatcaacgagtacatggagaacggctacgtttcctttgctctcggtcccattgttctgcccactctctacttcctcggtgtcaagctgtccgaggaagttgtccagtcctccgagtaccacaagctctacgaggtcatgtccacccagggccgactcatgaacgacatccactccttcaagcgagagaagaaggctggtaagctcaacgccgtcgccctctacatgtccgacggcaagtccggctccgtcgaagaggaagttgtcgaggagatgaagatcctcaccaagtcccagcgaaaggagatgatgaagctcgttctcgagactaagggctccgtcgtcccccgagtctgcaaggatgttttctggaacatgtgcaacgttctcaacctcttctacgccaccgacgacggtttcactggtaacgccattctcgatgttgtcaaggagatcatctacgagcccgtttcccacgagctcatc

SEQ ID NO: 157 - DNA, 2271 bp, Picea glauca
atgaagcgagagcagtacaccatcctcaacgagaaggagtccatggccgaggagctcatcctccgaatcaagcgaatgttctccgagattgagaacacccagacctccgcctccgcctacgacaccgcctgggttgccatggtcccctctctcgactcctcccagcagccccagttcccccagtgcctctcttggatcatcgacaaccagctcctcgacggctcttggggtatcccctacctcatcatcaaggaccgactctgccacaccctcgcctgtgtcattgctctgcgaaagtggaacgccggtaaccagaacgtcgagactggtctgcgattcctgcgagagaacattgagggtattgtccacgaggacgagtacacccccattggtttccagatcatcttccccgccatgctcgaggaagctcgaggtctgggtctggagctcccctacgatctgacccccatcaagctcatgctgacccaccgagagaagatcatgaagggcaaggccattgaccacatgcacgagtacgactcctctctcatctacaccgtcgagggtatccacaagattgtcgactggaacaaggttctcaagcaccagaacaaggacggctctctcttcaactccccctctgccaccgcctgtgctctcatgcacacccgaaagtccaactgtctggagtacctctcttccatgctccagaagctcggtaacggtgtcccctccgtctaccccatcaacctctacgcccgaatctccatgattgaccgactccagcgactcggtctggcccgacacttccgaaacgagatcatccacgccctcgacgacatctaccgatactggatgcagaaggagacttctcgagagggcaagtctctcacccccgacattgtttccacctccattgccttcatgctgctgcgactccacggctacgatgtccccgctgacgttttctgctgctaccacctccactccattgagcagtccggtgaggctgtcactgccatgctgtctctgtaccgagcctcccagatcatgttccccggtgagactatcctcgaggagatcaagaccgtttcccgaaagtacctcgacaagcgaaaggagaacggtcgaatctactaccacaacattgtcatgaaggacctccgaggtgaggttgagtacgccctctccgtcccctggtacgcctctctcgagcgaatcgagaaccgacgatacattgaccagtacggtgtcaacgacacctggatcgccaagacctcttacaagatcccctgtatctccaacgatctgttcctggctctggccaagcaggactacaacatctgtcaggccatccagcagaaggagctccgagagctcgagcgatggttcgccgacaacaagttctcccacctcaactttgcccgacagaagctcatctactgctacttctccgctgctgccactctcttctctcccgagctctctgctgctcgagttgtctgggccaagaacggtgtcatcaccaccgttgttgacgacttcttcgatgttggtggctcctccgaggagatccactcttttgtcgaggctgtccgagtctgggatgaggctgccaccgacggtctgtccgagaacgtccagatcctcttctccgctctgtacaacaccgttgacgagattgtccagcaggcctttgtctttcagggccgagacatctccatccacctgcgagagatctggtaccgactcgtcaactccatgatgaccgaggcccagtgggcccgaacccactgcatcccctccatgcacgagtacatggagaacgccgagccttccattgctctcgagcccattgttctctcctctctctactttgtcggccccaagctgtccgaggagatcatctgccaccccgagtactacaacctcatgcacctgctcaacatctgtggccgactcctcaacgatatccagggctgcaagcgagaggcccaccagggcaagctcaactccgtcactctctacatggaggagaactccggcaccaccatggaggatgccattgtctacctgcgaaagaccatcgacgagtcccgacagctcctcctcaaagaggttctgcgaccttccattgtcccccgagagtgcaagcagctccactggaacatgatgcgaatcctccagctcttctacctcaagaacgacggtttcacctcccccaccgagatgctcggctacgtcaacgccgtcattgtcgaccccatattg

SEQ ID NO: 158 - DNA, 900 bp, Bradyrhizobium japonicum
atgatccagaccgagcgagccgtccagcaggttctcgagtggggtcgatctctgaccggctttgccgacgagcacgccgtcgaggccgtccgaggtggtcagtacatcctccagcgaatccacccctctctgcgaggtacctccgcccgaaccggccgagatccccaggacgagactctcattgtcaccttctaccgagagctcgctctgctcttctggctcgacgactgcaacgatctcggcctcatctcccccgagcagctcgccgccgtcgagcaggctctcggccagggtgtcccctgtgctctgcccggtttcgagggctgtgccgtcctccgagcttctctcgccaccctcgcctacgaccgacgagactacgcccagctcctcgacgacacccgatgctactccgctgctctgcgagctggtcacgcccaggctgttgctgccgagcgatggtcctacgccgagtacctccacaacggtatcgactccattgcctacgccaacgttttctgctgtctgtctctgctctggggcctcgacatggccactctgcgagcccgacccgccttccgacaggttctgcgactcatctccgccatcggtcgactccagaacgatctccacggctgcgacaaggaccgatccgccggtgaggctgacaacgccgtcattctgctcctccagcgataccccgccatgcccgttgtcgagttcctcaacgacgagctcgccggccacacccgaatgctgcaccgagtcatggccgaggagcgattccccgctccctggggtcctctcattgaggccatggctgccatccgagtccagtactaccgaacctccacctcccgataccgatccgatgccgtccgaggtggtcagcgagctcccgcc

SEQ ID NO: 159 - DNA, 2838 bp, Phaeosphaeria sp
atgttcgccaagttcgacatgctcgaggaagaggcccgagctctggtccgaaaggtcggtaacgccgtcgaccccatctacggtttctccaccacctcctgccagatctacgacaccgcctgggccgccatgatctccaaagaggagcacggtgacaaggtctggctcttccccgagtccttcaagtacctcctcgagaagcagggtgaggacggctcttgggagcgacacccccgatccaagaccgtcggtgttctcaacaccgccgccgcctgtctggctctcctccgacacgtcaagaaccccctgcagctgcaggacattgctgcccaggacatcgagctccgaatccagcgaggtctgcgatctctcgaggagcagctcatcgcctgggatgacgttctggacaccaaccacattggtgtcgagatgattgtccccgctctgctcgactacctccaggccgaggacgagaacgtcgacttcgagtttgagtcccactctctgctcatgcagatgtacaaggagaagatggcccgattctcccccgagtctctctaccgagctcgaccctcttctgctctgcacaacctcgaggctctcatcggtaagctcgatttcgacaaggtcggccaccacctctacaacggctccatgatggcctccccctcttccactgccgccttcctcatgcacgcctctccctggtcccacgaggccgaggcctacctccgacacgtctttgaggctggtaccggcaagggctccggtggtttccccggtacctaccccaccacctactttgagctcaactgggtcctctccaccctcatgaagtccggcttcactctctccgatctcgagtgcgacgagctctcctccattgccaacaccatcgccgagggtttcgagtgcgaccacggtgtcatcggtttcgctccccgagccgtcgacgttgatgacactgccaagggtctgctcaccctcaccctcctcggtatggacgagggtgtctcccccgctcccatgattgccatgttcgaggccaaggaccacttcctgaccttcctcggtgagcgagatccctccttcacctccaactgccacgttctgctctctctgctccaccgaaccgacctcctccagtacctcccccagatccgaaagaccaccaccttcctctgtgaggcctggtgggcctgcgacggccagatcaaggacaagtggcacctctcccacctctaccccaccatgctcatggtccaggcctttgccgagatcctcctcaagtccgccgagggtgagcctctgcacgacgcctttgacgccgccactctgtctcgagtctccatctgtgttttccaggcctgtctgcgaactctgctcgcccagtcccaggacggctcttggcacggccagcccgaggcttcttgctacgccgtcctcaccctcgccgagtccggccgacttgttctgctccaggctctgcagccccagattgctgctgccatggagaaggctgctgatgtcatgcaggctggtcgatggtcttgttccgaccacgactgtgactggacctccaagaccgcctaccgagtcgacctcgttgctgctgcttaccgactcgccgccatgaaggcctcttccaacctcaccttcaccgtcgacgacaacgtttccaagcgatccaacggtttccagcagctcgtcggccgaaccgacctcttctccggtgtccccgcctgggagctccaggcctctttcctcgagtccgctctgtttgtccctctgctccgaaaccaccgactcgatgtctttgaccgagatgatatcaaggtttccaaggaccactacctcgatatgatccccttcacctgggtcggctgcaacaaccgatctcgaacctacgtttccacctccttcctcttcgacatgatgatcatctccatgctcggctaccagattgacgagttcttcgaggctgaggctgcccccgccttcgcccagtgcatcggtcagctccaccaggttgttgacaaggtcgtcgacgaggtcattgacgaggttgtcgacaaggttgtcggtaaggtcgtcggtaaggtcgtcggcaaggtcgtcgacgagcgagtcgactcccccacccacgaggccatcgccatctgcaacatcgaggcttctctgcgacgattcgtcgaccacgttctccaccaccagcacgttctgcacgcctcccagcaggagcaggatatcctctggcgagagctccgagccttcctgcacgcccacgttgtccagatggccgacaactccactctcgctcctcccggccgaaccttctttgactgggtccgaaccactgctgccgaccacgttgcctgtgcctactccttcgccttcgcctgctgcatcacctccgccaccattggccagggccagtccatgtttgccaccgtcaacgagctctacctggtccaggctgctgcccgacacatgaccaccatgtgccgaatgtgcaacgacattggctccgtcgaccgagacttcattgaggccaacatcaactccgtccacttccccgagttctccactctgtctctcgttgctgacaagaagaaggctctggcccgactcgccgcctacgagaagtcttgtctgacccacaccctcgaccagtttgagaacgaggttctccagtctccccgagtctcctccgccgcctccggtgacttccgaacccgaaaggtcgccgttgtccgattcttcgccgatgtcactgacttctacgaccagctctacatcctccgagatctgtcctcctctctcaagcacgtcgggaca

SEQ ID NO: 160 - DNA, 2856 bp, Gibberella fujikuroi
atgcccggcaagattgagaacggtacccccaaggacctcaagaccggcaacgacttcgtttccgctgccaagtctctgctcgaccgagccttcaagtcccaccactcctactacggtctgtgctccacttcctgccaggtctacgacaccgcctgggttgccatgatccccaagacccgagacaacgtcaagcagtggctcttccccgagtgtttccactacctgctcaagacccaggctgctgacggctcttggggctctctgcccaccacccagaccgccggtatcctcgacactgcctccgccgttctggctctgctctgccacgcccaggagcctctgcagatcctcgatgtctcccccgatgagatgggtctgcgaatcgagcacggtgtcacttctctcaagcgacagctcgccgtctggaacgacgttgaggacaccaaccacattggtgtcgagttcatcatccccgctctgctctccatgctcgagaaggagctcgatgtcccctccttcgagttcccttgccgatccattctggagcgaatgcacggcgagaagctcggtcactttgatctcgagcaggtctacggcaagccctcttctctgctgcactctctcgaggccttcctcggcaagctcgatttcgaccgactctcccaccacctctaccacggctccatgatggcctccccctcttccaccgccgcctacctcattggtgccaccaagtgggacgacgaggccgaggactacctccgacacgtcatgcgaaacggtgccggccacggtaacggtggtatctctggtaccttccccaccacccactttgagtgctcctggatcattgccactctcctcaaggtcggtttcactctcaagcagattgacggtgacggtctgcgaggcctctccaccattctcctcgaggctctgcgtgacgagaacggtgtcattggcttcgctccccgaaccgccgacgttgatgacactgccaaggctctgctggctctgtctctggtcaaccagcccgtttcccccgacatcatgatcaaggttttcgagggtaaggaccacttcaccacctttggctccgagcgagatccctctctgacctccaacctccacgttctcctctctctgctcaagcagtccaacctgtctcagtaccacccccagatcctcaagaccactctcttcacctgtcgatggtggtggggctccgaccactgtgtcaaggacaagtggaacctctcccacctctaccccaccatgctcctcgtcgaggccttcaccgaggttctgcacctcatcgacggtggtgagctctcctctctgtttgacgagtctttcaagtgcaagatcggtctgtccatcttccaggccgttctccgaatcatcctcacccaggacaacgacggctcttggcgaggctaccgagagcagacctgttacgccattctcgccctcgtccaggcccgacacgtctgtttcttcacccacatggtcgaccgactccagtcctgtgtcgaccgaggtttctcttggctcaagtcttgctccttccactctcaggacctcacctggacctccaagaccgcttacgaggttggtttcgttgccgaggcctacaagctcgctgctctccagtccgcctctctcgaggtccccgctgccaccatcggccactccgtcacctctgctgtcccctcctccgatctcgagaagtacatgcgactcgtccgaaagaccgctctgttctctcccctcgatgagtggggtctgatggcctccatcatcgagtcctccttctttgtccccctcctccaggcccagcgagttgagatctacccccgagacaacatcaaggtcgacgaggacaagtacctctccatcatccccttcacctgggttggctgcaacaaccgatctcgaacctttgcctccaaccgatggctctacgacatgatgtacctgtctctgctcggctaccagaccgacgagtacatggaggccgttgccggccccgtctttggtgatgtctctctgctgcaccagaccatcgacaaggtcattgacaacaccatgggtaacctggcccgagccaacggtaccgtccactccggcaacggtcaccagcacgagtcccccaacattggccaggtcgaggacaccctcactcgatttaccaactccgtcctcaaccacaaggacgtcctcaactcctcctcctccgaccaggacaccctccgacgagagttccgaaccttcatgcacgcccacatcacccagatcgaggacaactcccgattctccaagcaggcttcttccgacgccttctcctcccccgagcagtcctacttccagtgggtcaactccactggtggttcccacgttgcctgcgcctactctttcgccttctccaactgcctcatgtccgccaacctcctccagggtaaggacgccttcccttccggtacccagaagtacctcatctcctccgtcatgcgacacgccaccaacatgtgccgaatgtacaacgatttcggttccatcgcccgagacaacgccgagcgaaacgtcaactccatccactttcccgagttcactctctgtaacggtacctcccagaacctcgacgagcgaaaggagcgactcctcaagattgctacttacgagcagggctacctcgaccgagctctcgaggctctggagcgacagtcccgagatgatgctggtgaccgagccggctccaaggacatgcgaaagctcaagattgtcaagctcttctgtgacgtcaccgacctctacgaccagctctacgtcatcaaggacctctcctcctccatgaaa

SEQ ID NO: 161 - DNA, 1533 bp, Lactuca sativa
atggatctgcagaccatggcccccatgggctctgctgccattgccatcggtggtcccgctgttgccgttgctggtggtatctctctgctcttcctcaagtctttcctgtcccagcagcccggcaaccccaaccacctcccctccgtccccgctgtccccggtgtccctctgctcggtaacctgctcgagctcaaggagaagaagccctacaagaccttcaccaagtgggccgagacttacggccccatctactccatcaagactggtgccacctccatggtcgttgtcaactccaaccagctcgccaaagaggccatggtcacccgattcgactccatctccacccgaaagctctccaaggctctccagattctcactgctgacaagaccatggttgccatgtccgactacgacgactaccacaagaccgtcaagcgaaacctgctcacctccatcctcggtcccgctgcccagaagcgacaccgagcccaccgagatgccatgggtgacaacctgtctcgacagctccacgctcttgctctcaactctcctcaagaggccatcaacttccgacagatcttccagtccgagctcttcactctcgccttcaagcagacctttggccgagacattgagtccatcttcgtcggtgatctcggtaccaccatgacccgagaggagatgttccagatcctcgttgtcgaccccatgatgggtgccattgacgttgactggcgagacttcttcccctacctcaagtggatccccaacgccaagctcgaggagaagattgagcagatgtacatccgacgaaaggccgtcatgaaggccgtcatccaggagcaccgaaagcgaattgactccggcgagaacctcgactcttacattgacttcctgctcgccgaggcccagcctctgaccgagaagcagctcctcatgtctctgtgggagcccatcattgagacttccgacaccaccatggtcaccaccgagtgggccatgtacgagctctccaagcaccccaacaagcagcagcgactctacaacgagatccgaaacatctgtggttccgagaagatcaccgaggagaagctctgcaagatgccctacctgtctgctgttttccacgagactctgcgagtccactcccccgtttccatcatccccctgcgatacgtccacgagaacaccgagctcggcggctaccacgtccccgccggcaccgagctcgccgtcaacatctacggctgcaacatggagcgagagatctgggagaaccccgaggagtggtcccccgagcgattcctcgccgagaacgagcccgtcaacctgcagaaaaccatggcctttggtgctggtaagcgagtctgcgctggtgccatgcaggccatgctgctcgcctgtgtcggtattggccgaatggtccaggagtttgagtggcgactcaaggacgacgttgaagaggatgtcaacaccctcggcctcaccacccagcgactcaaccccatgctcgccgtcatcaagccccggaat

SEQ ID NO: 162 - DNA, 1536 bp, Lactuca sativa
atggacggtgtcattgacatgcagaccatccccctgcgaactgccattgccattggtggtactgctgttgctctcgttgttgctctctacttctggttcctgcgatcttacgcctccccctctcaccactccaaccaccttcctcccgtccccgaggtccccggtgtccccgtcctcggtaacctgctccagctcaaggagaagaagccctacatgaccttcaccaagtgggccgagatgtacggccccatctactccatccgaaccggtgccacctccatggttgttgtctcttccaacgagattgccaaggaagttgttgtcacccgattcccctccatctccacccgaaagctctcttacgctctcaaggtcctcactgaggacaagtccatggttgccatgtccgactaccacgactaccacaagaccgtcaagcgacacattctcaccgccgtcctcggccccaacgcccagaagaagttccgagcccaccgagacaccatgatggagaacgtttccaacgagctccacgccttcttcgagaagaaccccaaccaggaagtcaacctgcgaaagatcttccagtctcagctctttggtctggccatgaagcaggctctcggcaaggatgtcgagtccatctacgtcaaggatctcgagactaccatgaagcgagaggagatcttcgaggttctggtcgtcgaccccatgatgggtgccattgaggtcgactggcgagacttcttcccctacctcaagtgggtccccaacaagtctttcgagaacatcatccaccgaatgtacacccgacgagaggctgtcatgaaggctctcatccaggagcacaagaagcgaattgcctccggtgagaacctcaactcctacattgactacctgctctccgaggcccagaccctcaccgacaagcagctcctcatgtctctgtgggagcccatcatcgagtcctccgacaccaccatggtcaccaccgagtgggccatgtacgagctcgccaagaaccccaacatgcaggaccgactctacgaggagatccagtctgtctgtggctccgagaagatcactgaggagaacctgtcccagctcccctacctctacgccgttttccaggagactctgcgaaagcactgccccgtccccatcatgcccctgcgatacgtccacgagaacaccgtcctcggtggctaccacgtccccgctggtaccgaggttgccatcaacatctacggctgcaacatggacaagaaggtctgggagaaccccgaggagtggaaccccgagcgattcctgtccgagaaggagtccatggacctctacaagaccatggcctttggtggtggcaagcgagtctgtgccggctctctgcaggccatggtcatctcctgcattggtatcggtcgactcgtccaggactttgagtggaagctcaaggacgatgctgaggaagatgtcaacaccctcggcctcaccacccagaagctccaccctctgctcgccctcatcaacccccggaaa

SEQ ID NO: 163 - DNA, 1575 bp, Sphaceloma manihoticola
atgatggacgacaccacctccccctactccacctaccactccgtccgatccatccgaaaccagtccgcctgggctctggcccccattgccgtctttatctgctacgttgttctgcgacacaaccgaaagtccgtccccgctgcctctgctggttcccactccatcctcgagcccctgtggctcgcccgactccgattcatccgagactctcgattcatcatcggtcagggctactccaagttcaaggacaccatcttcaaggtcaccaaggtcggtgccgatatcattgttgttgctcccaagtacgtcgaggagatccgacgactctcccgagacaccggccgatccgtcgagcccttcatccacgactttgccggtgagctcctcggtggcctcaacttcctcgagtccgatctccagacccgagttgtccagcagaagctcacccccaacctcaagaccattgtccccgtcatggaggacgagatgcactacgctctcgtttccgagctcgactcttgtctcgatggttccgagcactggacccgagtcgacatgatccacatgctctcccgaattgtctctcgaatctccgcccgaatcttcctcggccccaagtactgccgaaacgatctgtggctcaagaccactgccgagtacaccgagaacctcttcctgaccggtactctgctccgattcgtcccccgaatgctccagaagtggatcgctcctctgctcccctctttccgacagctccaggagaaccgacaggccgcccgaaagatcatctccgagattctgaccgaccaccagcccgagaagcacgacgagacttccgacaacggtgacccctaccccgacattctcaccctcatgttccaggctgcccgaggtaaggagaaggacattgaggacattgcccagcacactctgctcctctctctgtcctccatccacaccactgctctgaccatgacccaggctctctacgatctctgtgcctacccccagtacctcgaccccgtcaagcacgagattgccgacactctgcagtccgagggctcttggtccaaggccatgctcgacaagctccacatgatggactctctgctccgagagtcccagcgactctctcccgtctttctgctcaccttcaaccgaatcctccacacccctctgaccctctccaacggtatccacctccccaagggtacccgaattgccgccccctccgacgccatcctcaacgacccctctctggtccccggcccccagcccgctgacaccttcgaccccttccgatacatcaaccactccaccggtgatgccaagaaaaccaagaccaacttccagaccacctctctgcagaacatggcctttggctacggtaagtacgcctgccccggccgattctacgttgccaacgagatcaagctcgttctcggccacctgctcatgcactacgagttcaagttccctcccggtatgggccgacccgtcaactccactgtcgacaccgacatgtaccccgatctcggtgcccgactcctcgtccgaaagcgaaagatggaggag

SEQ ID NO: 164 - DNA, 1440 bp, Artemisia annua
atgcccatgaccgtcatgctgctctttgttttcctgctcttcattgccatctgtttcttcctcgtccaccgacacaactccaccaccaccaagaacctgcctcccggctccttcggctggcccttcattggtgagactctcgcctacatccgatccaagcgaggtggtgaccccgagcgattcaccaaggagcgaatcgagaagtacggctccactctggtctttaagacctccgttgccggtgagcgaatggccgttttctgcggtcccgagggtaacaagttcctctttggcaacgagaacaagctcgttgcttcttggtggcccaactccgtccgaattctcttcgagaagtgtctgatcaccatccgaggtgacgaggccaagtggctccgaaagatgatgttcgcctacctcggtcccgatgctctgtccaaccgatacaccggtaccatggaggttgtcacccgactccacatccagaaccactggcagggcaagtccgagctcaaggtctttgagactgtccgaccttacctcttcgagctcgcctgccgactcttcctgtctctcgacgaccccaagcacgttgccgagctcggtaccctcttcaacaccttcctcaagggtctgaccgagctccccatcaacatccccggtacccgattctaccgagccaagcgagctgccaacgccatcaagaagcagctcattgtcatcatcaagcagcgacgacaggctctcaagcaagaggaccagtcctcctccttcgaggacctcctctcccacctccttgtctcctccgacgagaacggccgattcctgtccgaggctgagattgccaacaacgttctgctcctcctcttcgccggccacgacacttctgctgtctccatcactctgctcatgaagtctctggccgagcacccccaggtctacgacaacgtcctcaaggagcagctcggtattctcgaggccaaggctcccggtgagatgctcaactgggaggatatccagaagatgcgatactcttggtacgttgtctgcgaggtcatgcgactcattcctcccgttgtcggctctttccgagaggctctggtcgactttgagtacgccggctacaccatccccaagggctggaagatcatctggtccgccgtcatgacccacaaagaggagaacaacttccccaacgccaccaagttcgacccctctcgattcgagggtgctggtcccacccccttcacctacgtccccttcggtggtggcccccgaatgtgcctcggcaaggagctcgcccgagtccgaatcctcgtctttctgcacaacatcatgaccaagttcaagtgggatctgctcatccccgacgagaagattggctacgaccccctcgccacccccgtcaagggtctgcccgtccgactccacccccaccaggtt

SEQ ID NO: 165 - DNA, 1365 bp, Ricinus communis
atggagctcgtcatgttccccgttctggctctcgtttccactctcttcctgctcgccctccacttcatcatccgaaccctcaaggagcgactctttggctctcccaacctgcctcccggccgactcggctggcccctcattggtgagactcccgccttcttccgagctggctttgaggccaagcccgagaagttcatcggtgagcgaatggagaagtacgactcccgagtctttaagacctctctgctcggcaagcccttcgccgtcatctccggtaccgccggccacaagttcctcttctccaacgagaacaagctcgtcaacctgtggtggcccgagtccgtccgaatgctcttcaagtctgctctcgtttccgttgtcggtgacgaggccaagcgaatccgaaagatgctcatgaccttcctcggcctcgatgctctcaagaactacaccgagcgaattgacatggtcacccagcagcacatccgaacctactgggagggtaaagaggaagtcaccgtctactccactctcaagctctacaccttcactctggcctgcaacctcttcgcctccatcaacgaccccgagcgactctccaagctcggtgcccacttcgacgtctttgtcaagggtgtcatctctctgcccatctccatccccggtacccgactctacaagtccatgaaggctgccaacgccatccgagaggagctcaagctcattgtccgagatcgaaaagaggctctcgagcgaaagatggcctcccccacccaggatctgctctcctacctgctcgtcgactccgacaccaacggccgattcctgtccgagatggagattctcgacaacatcatgctgctcctctacgctgagcagctcgagattgccaactccaagaagcccggtgagctgctccagtgggaggacgtccagaagatgcgatactcttggaacgtcatctccgaggttctgcgactgtctcctcccgtttcttctgcctaccgacacgccattgttgacttcacctacgagggttacaccatccccaagggctggcagctcttcacctccttcggtaccacccaccgagatcccgctctcttccccaaccccgagcgattcgacgcctctcgattcgagggtaacggtcctccctcctactcctacatccccttcggtggtggtccccgaatgtgcattggctacgagtttgcccgactcgagatgctcatcttcctgcacaacatcatcaagcgattcaagtgggacattctcatccccgacgagcagtttggctacaaccccctgctcgccccctcccagggtttccccgtccgactgcgaccccaccactcccatctc

SEQ ID NO: 166 - DNA, 1428 bp, Stevia rebaudiana
atgatccaggttctgacccccatcctcctcttcctcatcttcttcgttttctggaaggtctacaagcaccaaaagaccaagatcaacctgccccctggctccttcggctggcccttcctcggtgagactcttgctctgctccgagccggctgggactccgagcccgagcgattcgtccgagagcgaatcaagaagcacggctctcctctcgttttcaagacctctctcttcggtgaccgattcgccgttctctgtggtcccgctggtaacaagttcctcttctgcaacgagaacaagctcgttgcctcttggtggcccgtccccgtccgaaagctcttcggcaagtctctgctcaccatccgaggtgacgaggccaagtggatgcgaaagatgctgctctcctacctcggtcccgatgcctttgccacccactacgctgtcaccatggacgttgtcacccgacgacacattgacgtccactggcgaggcaaggaagaggtcaacgttttccagaccgtcaagctctacgcctttgagctcgcctgccgactcttcatgaacctcgacgaccccaaccacattgccaagctcggctctctcttcaacatcttcctcaagggtatcatcgagctccccattgacgttcccggtacccgattctactcctccaagaaggctgctgctgccatccgaatcgagctcaagaagctcatcaaggcccgaaagctcgagctcaaggaaggcaaggcctcctcctcccaggatctgctgtcccacctgctcacctcccccgacgagaacggtatgttcctgaccgaggaagagattgtcgacaacattctgctcctcctctttgccggccacgacacctctgctctgtccatcactctgctcatgaaaactctcggtgagcactccgatgtctacgacaaggtcctcaaggagcagctcgagatctccaagactaaagaggcctgggagtctctcaagtgggaggacatccagaagatgaagtactcctggtccgtcatctgcgaggtcatgcgactcaaccctcccgtcatcggtacctaccgagaggctctggtcgacattgactacgccggctacaccatccccaagggctggaagctccactggtccgctgtctccacccagcgagatgaggccaactttgaggacgtcacccgattcgacccctctcgattcgagggtgccggtcccactcccttcacctttgtccccttcggtggtggtccccgaatgtgtctcggcaaggagtttgcccgactcgaggttctggccttcctgcacaacattgtcaccaacttcaagtgggatctgctcatccccgacgagaagattgagtacgaccccatggccacccccgccaagggtctgcccatccgactccacccccaccaggtg

SEQ ID NO: 167 - DNA, 1575 bp, Arabidopsis thaliana
atggagtctctggttgtccacaccgtcaacgccatctggtgcattgtcattgtcggtatcttctccgtcggctaccacgtctacggccgagctgttgtcgagcagtggcgaatgcgacgatctctcaagctccagggtgtcaagggtcctcctccctccatcttcaacggtaacgtttccgagatgcagcgaatccagtccgaggccaagcactgctccggtgacaacatcatctcccacgactactcttcttctctgttcccccactttgaccactggcgaaagcagtacggccgaatctacacctactccactggcctcaagcagcacctctacatcaaccaccccgagatggtcaaggagctctcccagaccaacaccctcaacctcggccgaatcacccacatcaccaagcgactcaaccccattctcggtaacggtatcatcacctccaacggcccccactgggcccaccagcgacgaatcattgcctacgagttcacccacgacaagatcaagggtatggtcggtctgatggtcgagtccgccatgcccatgctcaacaagtgggaggagatggtcaagcgaggtggtgagatgggctgtgacatccgagtcgacgaggacctcaaggatgtctccgctgacgtcattgccaaggcctgtttcggctcttccttctccaagggcaaggccatcttctccatgatccgagatctgctcaccgccatcaccaagcgatccgtcctcttccgattcaacggtttcaccgacatggttttcggctccaagaagcacggtgacgttgacattgacgctctcgagatggagctcgagtcctccatctgggagactgtcaaggagcgagagattgagtgcaaggacacccacaagaaggacctcatgcagctcattctcgagggtgccatgcgatcttgtgacggtaacctgtgggacaagtctgcttaccgacgattcgttgtcgacaactgcaagtccatctactttgccggccacgactccaccgccgtttccgtttcttggtgcctcatgctgctcgctctcaacccctcttggcaggtcaagatccgagatgagattctgtcctcctgcaagaacggtatccccgacgccgagtccatccccaacctcaagaccgtcaccatggtcatccaggagactatgcgactctaccctcccgctcccattgtcggccgagaggcctccaaggacattcgactcggtgatctggttgtccccaagggtgtctgtatctggaccctcatccccgctctgcaccgagatcccgagatctggggtcccgacgccaacgacttcaagcccgagcgattctccgagggtatctccaaggcctgcaagtacccccagtcctacatcccctttggcctcggcccccgaacctgtgtcggcaagaactttggtatgatggaggtcaaggtcctcgtttctctgattgtctccaagttctccttcactctgtctcccacctaccagcactctccctcccacaagctgctcgtcgagccccagcacggtgttgtcatccgagttgta

SEQ ID NO: 168 - DNA, 1437 bp, Ixeris dentata
atggacgccgttgccgtcaactccgagactatgtcccacgttgtctttatccccttccccgcccagtcccacatcaagtgcatgctcaagctcgcccgactgctgcaccacaagggtctgcacatcacctttgtcaacaccgagctcaaccacaaccagctgctgtcctccggtggtcccaactctctcgacggtgagcccggtttccgattcaagaccatccccgatggtgtccccgagggtgctcccgacttcatgtacgctctgtgtgactccgttctcaacaagatgctcgaccccttcgtcgatctcattggccgactcgagtcccccgccacctgtatcatcggtgacggtatgatgcccttcactgttgctgctgccgagaagctcaagctccccatcatgcacttctggaccttccccgctgctgccttcctcggctactaccaggcccccaacctcattgagaagggcttcatccctcccaaggacgagtcttggtccaccaacggctacctcgagactgttgtcgactccatctccggtctggagggtttccgaatccgagacatccccgcctacttccgaaccaccgaccccaacgactccgacttcaactacatcattgagtgtgtcaaggccatccgaaaggtttccaacattgttctccacacctttgaggagctcgagtccaccatcatcaaggctctgcagcccatgatcccccacgtctacaccattggccccctcgagctcctcctcaaccccatcaagctcgaagaggagactgagaagctcgatatcaagggctactctctgtggaaggaagatgacgagtgcctcaagtggctcgactccaaggagcccaactccgtcatctacgtcaacttcggctctctcatctccatgtccaaggagcagctcgccgagtttggctggggtctggtcaactccaaccactgcttcctctgggtcatccgacgagatctggttgtcggtgactctgctcctctgcctcccgagctcaaggagcgaatcaacgagcgaggtttcattgcctcttggtgcccccaggagaaggtcctcaagcactcctccgtcggtggtttcctcacccactgtggctggggctccatcatcgagtctctgtccgccggtgtccccatgctctgctggccctacctctgggaccagcccaccaactgccgacaggcctgcaaggagtgggaggtcggtctggagattgagggtaacgtcaacaaggacgaggtcgagcgactcacccgagagctcattggtggtgagaagggcaagcagatgcgatccaaggccctcgagtggaagaagaagattgagattgccaccggccccaagggctcttcttctctcaacgtcgagcgactggccaacgacatcaacatgttctcccgaaat

SEQ ID NO: 169 - DNA, 1446 bp, Ricinus communis
atgggctccattgtccgagatcacgacaagccccacgttgtctgtgtcccctaccccgcccagggccacgtcaaccccatggtcaagctcgccaagctcctccactacaacgacttccacgtcacctttgtcaacaccgagtacaaccaccgacgactcctcaactcccgaggcccctcttctctcgacggcctccccgacttccgattcgaggccatctccgacggtctgcccccttccgacgccaacgccacccaggatatcccctctctctgtgactccacctccaagaactctctggcccccttccgaaacctgctgctcaagctcaagtcctccgactctctgcctcccgtcacctgtatcatctccgacgcctgcatgtccttcaccctcgatgctgctgaggagttcggtatccccgagatcctcttctggaccccctcttcttgtggtgttctcggctactcccagtaccacactctcattgagaagggtctgactcccctcaaggacgcctcctacctgaccaacggctacctcgagactaccctcgactggatccccggtatgaaggacatccgattccgagatctgccctctttcatccgaaccaccgaccgaaacgacatcatgctcaacttcgttgtccgagagctcgagcgaacctcccgagcctctgctgttgttttcaacaccttctacgcctttgagaaggacgttctcgacgttctgtccaccatgttccctcccatctactccatcggtcccctccagctcctcgtcgaccagatccccattgaccgaaacctcggtaacattggctccaacctgtggaaggagcagcccgagtgcattgactggctcgacaccaaggagcccaactccgttgtctacgtcaactttggctccatcaccgtcatcactccccagcagatgattgagtttgcctggggtctggcctcttccaagaagcccttcctgtggatcatccgacccgatctggtcattggtgagaacgccatgctccccgctgagtttgtctccgagactaaggaccgaggtatgctcgcctcttggggtccccaggagcagatcctcaagcaccccgctgtcggtggtttcctgtcccacatgggctggaactccaccctcgactccatgtccggtggtgtccccatggtctgctggcccttcttcgccgagcagcagaccaactgccgattcgcctgcaccgagtggggtgtcggtatggagattgacaacaacgtcaagcgagatgaggtcaagaagctcgttgaggtcctcatggacggcaagaagggcaaggagatgaagtccaaggccatggagtggaaaaccaaggctgaggaagctgccaagcccggtggttcctcccacaacaacctcgaccgactcgtcaagttcatcaagggccagaagaat

SEQ ID NO: 170 - DNA, 1374 bp, Ixeris dentata
atggccgaggagcacaacaagaccaacaactcctctccccacgttgtcatcttccccttcccctcccagggccacatcaaccccctcatccagtttgccaagcgactctcctccaagggtgtcaagcccactctcatcaccaccatctacattgccaagacctctccttaccccaactcctccattgttgtcgagcccatctccgacggtttcgacgacggtggtttcaagtccgccacctccgctgagtcctacattgacaccttccaccaggtcggctccaagtctctggccaacctcatccgaaagctcgtcaacgagggcaaccacgttgatgccatcatctacgactccttcgtcacctgggctctcgatgttgccatggagtacggtattgacggtggctgcttcttcacccaggcctgtgccgtcaacaacatctactaccacgtctacaagggtgtcctcgagatccccctgcaggctgctgctcctcccaccgtcaccattctgctccccgagctcccccagctccagctgtgggagactccctcttttgtccacaaccccggcccctaccccggctgggcccacattgtctttaaccagttccccaacatccacaacgcccgatgggttttctccaacaccttcttcaagctcgaggagcaggtcatcaagtggatgcgactcatgtggcctctcatggtcgtcggtcccaccgtcccctccatgtacctcgacaagcgactcgaggacgacgacgactacggtatgtctctgctcaagcccaaccacattgagtgcatgggctggctcaacaacaagcccaagggctccgtcgtctacgtttctttcggctcttacggtgagctcggtgttgcccagatggaggagattgcctggggtctgaacgagtcctccgtcaactacctgtgggttgtccgagagactgagaaggagaagctccccaagtccttcctggccaacggtctgattgtcgagtggtgccgacagctcgaggtcctcgcccacgaggctgttggctgtttcgtcacccactgcggtttcaactcctctctcgagactatctctctcggtgtccccgttgttgccatcccccagtggaccgaccagaccaccaacgccaagtgcctcgaggatatctggggtgtcggtatccgagccaagacccccgtcacccgaaccaacctggtctggtgcatcaaggagatcatggagggtgagcgaggtgctgttgctcgaaagaacgccatcaagtggaaggatctggccattgaggctgtctcccccggcggctcttccgacaaggacatcaacgagtttgtctcccagctctcccccatcaagtgt

SEQ ID NO: 171 - DNA, 1362 bp, Populus trichocarpa
atggacaacaagaagtcccacgtcattgttctgacctaccccgcccagggccacatcaaccccctgctccagtttgccaagcgactcgcctccaagggcctcaaggccactctggccaccacctactacaccgtcaactccatcgacgcccccaccgtcggtgttgagcccatctccgacggtttcgacgagggtggtttcaagcaggcttcttctctcgatgtctacctcgagtccttcaagaccgtcggctcccgaactctgaccgagctcgttttcaagttcaaggcttccggctctcccgtcaactgtgttgtctacgactccatgctcccctgggccctcgacgttgctcgagatctcggtatctacgctgctgccttcatgaccacctctgcttccgtctgctccatgtactggcgaatcgatctcggtctgctgtctctgcccctcaagcagcagaccgccactgtctctctgcccggtctgccccctctcggctgctgtgacctcccctctttcctcgccgagcccacctcccagaccgcctacctcgaggtcatcatggagaagttccactctctcaacgaggacgactgggttttctgcaactccttcgaggacctcgagattgagctcgtcaaggccatgcgaggcaagtggcccctcgtcatggtcggccccatggtcccctccgcctacctcgaccagcagatcgacggtgaccgagcctacggtgcttctctgtggaagcccacctcctcccagtgcttcacctggctcgacaccaagccccctcgatccgtcatctacgtttccttcggctccatgggcaacatctccgccgagcaggttgaggagattgcctggggcctcaaggcttccaaccgacccttcctgtgggtcatgaaggagtccgagaagaagctccccaccggtttcctcaactccgtcggtgagactggtatggttgtctcttggtgcaaccagctcgaggttctcgcccaccaggccattggctgctttgtcacccactgtggctggaactccactctcgagggtctgggcctcggtgtccccatggtctgtgtcaccgagcgatccgaccagcccatgaacgccaagttcgtcgaggatgtctggaaggtcggtgtccgagccaagaaggacgaggttggtattgtcacccgagaggagctcgagaagtgcatccgaggtgtcatggacggtgagaacggtgaggagatcaagcgaaacgccaacaagtggcgagagctcgcccgatctgctgtttccgtcggtggttcctccgacatgaacatcaacgagtttgttgtcaagctgctcgagggcaagaaggga

SEQ ID NO: 172 - DNA, 1377 bp, Nicotiana tabacum
atgaccacccagaaggcccactgtctgatcctcccctaccccgcccagggccacatcaaccccatgctccagttctccaagcgactccagtccaagggtgtcaagatcaccattgctgccaccaagtctttcctcaagaccatgcaggagctgtccacctctgtctccgtcgaggccatctccgacggctacgacgacggtggccgagagcaggctggtacctttgtcgcctacatcacccgattcaaagaggttggctccgacactctgtcccagctcatcggtaagctcaccaactgtggctgccctgtctcttgcattgtctacgaccccttcctgccctgggctgtcgaggtcggtaacaacttcggtgttgccactgctgccttcttcacccagtcttgtgccgtcgacaacatctactaccacgtccacaagggtgttctcaagctccctcccaccgacgttgacaaggagatctccatccccggtctgctcaccattgaggcttccgatgtcccctcttttgtctccaaccccgagtcctcccgaatcctcgagatgctcgtcaaccagttctccaacctcgagaacaccgactgggttctcatcaactccttctacgagctcgagaaggaagtcattgactggatggccaagatctaccccatcaagaccattggccccaccatcccctccatgtacctcgacaagcgactccccgatgacaaggagtacggtctgtccgtctttaagcccatgaccaacgcctgcctcaactggctcaaccaccagcccgtttcttccgtcgtctacgtttctttcggctctctggccaagctcgaggctgagcagatggaggagctcgcctggggtctgtccaactccaacaagaacttcctgtgggttgtccgatccactgaggagtccaagctccccaacaacttcctcgaggagctcgcctccgagaagggtctggttgtctcttggtgcccccagctccaggttctcgagcacaagtccatcggttgcttcctgacccactgcggctggaactccactctcgaggccatctctctcggtgtccccatgattgccatgccccactggtccgaccagcccaccaacgccaagctcgtcgaggatgtctgggagatgggtatccgacccaagcaggatgagaagggtctggtccgacgagaggtcattgaggagtgtatcaagattgtcatggaggagaagaagggcaagaagatccgagagaacgccaagaagtggaaggagctcgcccgaaaggctgttgacgagggtggctcttccgaccgaaacattgaggagttcgtttccaagctcgtcaccatcgcttccgtcgaatcg

SEQ ID NO: 173 - DNA, 1434 bp, Vaccaria hispanica
atgtccaacaacgagaacaacgccacccaggtcattgttctgccctaccacggccagggccacatgaacaccatggtccagtttgccaagcgactcgcctggaagggtgtccacgtcaccatcgccaccaccttcaacaccatccagcagatgaagctcaacatctcctcttacaactccatcactctcgagcccatctacgacgacaccgacgactccactctgcacatcaaggaccgaatggcccgattcgaggctgaggctgcctccaacctgacccgagttctcgaggccaagaagcagcagcaggctctcaacaagaagtgtctgctcgtctaccacggctctctcaactgggccctcgttgtcgcccaccagcagaacgttgccggtgctgccttcttcaccgccgcctctgcttctttcgcctgctactactacctgcacctcgagtcccagggcaagggtgtcgatctcgaggagctcccctccattctgccccctcccaaggtcatcgtccagaagctccccaagtccttcctggcctacggtgacaacaactcccacaacaacaacaataacaacaataacaacaacaataacaacaacatgggtctgcaccctctggttctgtggctcctcaaggactacggcaactccgtcaaggccgactttgtcctcctcaactccttcgacaagctcgaggaagaggccatcaagtggatctccaacatctgctccgtcaagaccatcggtcccaccatcccctccacctacctcgacaagcagatcgagaacgatgtcgactacggtttcaaccagtacaagcccaccaacgaggactgcatgaagtggctcgacaccaaggaagccaactccgttgtctacattgccttcggctctgttgctcgactgtccgtcgagcagatggccgagattgccaaggctctcgaccactcctccaagtctttcatctgggttgtccgagagactgagaaggagaagctccccgtcgacctcgtcgagaagatctccggccagggtatggttgtcccctgggctccccagctcgaggtcctcgcccacgatgctgtcggctgtttcgtttcccactgtggctggaactccaccattgaggctctgtctttcggtgtccccatcctcgccatgccccagttcctcgaccagctcgttgatgcccactttgtcgaccgagtctggggtgtcggtattgcccccactgtcgacgagaacgatctcgtcacccaggaagagatctcccgatgcctcgacgagatgatgggtggtggtcccgagggtgagaagatcaagaagaacgttgccatgtggaaggagctgaccaaagaggctctcgacaagggtggctcttccgacaagcacattgacgagatcattgagtggctctcttctagt

SEQ ID NO: 174 - DNA, 1443 bp, Streptococcus mutans
atgcccatcatcaacaagaccatgctcatcacctacgccgactctctcggcaagaacctcaaggagctcaacgagaacattgagaactacttcggtgatgctgttggtggtgtccacctgctccccttcttcccctccactggtgaccgaggcttcgcccccattgactaccacgaggttgactctgccttcggtgactgggatgatgtcaagtgcctcggtgagaagtactacctcatgttcgacttcatgatcaaccacatctcccgacagtccaagtactacaaggactaccaggagaagcacgaggcttctgcctacaaggacctcttcctcaactgggacaagttctggcccaagaaccgacctacccaggaagatgtcgatctcatctacaagcgaaaggaccgagctcccaagcaggagatccagtttgccgacggctccgtcgagcacctgtggaacaccttcggtgaggagcagattgacctcgatgtcaccaaggaagtcaccatggacttcatccgatccaccattgagaacctggctgccaacggctgtgacctcatccgactcgacgcctttgcctacgccgtcaagaagctcgacaccaacgacttcttcgtcgagcccgagatctggactctgctcgacaaggtccgagacattgctgccgtttccggtgccgagatcctccccgagatccacgagcactacaccatccagttcaagattgctgaccacgactactacgtctacgactttgctctgcccatggtcactctgtactctctgtactcctccaaggtcgaccgactcgccaagtggctcaagatgtctcccatgaagcagttcaccaccctcgacacccacgacggtatcggtgttgttgatgtcaaggacattctgaccgacgaggagatcacctacacctccaacgagctctacaaggtcggtgccaacgtcaaccgaaagtactccactgccgagtacaacaacctcgatatctaccagatcaactccacctactactctgctctcggtgacgacgaccagaagtacttcctggcccgactcatccaggcctttgcccccggtatcccccaggtctactacgttggcttcctcgccggcaagaacgatctcgagctgctcgagtccaccaaagagggccgaaacatcaaccgacactactactcctccgaggagattgctaaagaggtcaagcgacccgttgtcaaggctctgctcaacctcttcacctaccgaaaccagtccgccgcctttgacctcgacggccgaatcgaggttgagactcccaacgaggccaccattgtcatcgagcgacagaacaaggacggctctcacattgccaaggccgagatcaacctgcaggacatgacctaccgagtcaccgagaacgaccagaccatctccttcgag

SEQ ID NO: 175 - DNA, 1392 bp, Lobelia erinus
atggacaacaaccacctcggtgagactctgctccccctcgctcccaagaacggccgacgagttctcttcttcccctaccccctccagggccacatctcccccatgctcaacctcgccaacctgctccactccaagggtttcaccatcaccatcatccacaccaacctcaactcccccaaccagtccgactacccccacttcaccttccgaccctttgacgacggtttccctccttactccaagggctggcagctcgccaccctctgctcccgatgtgtcgagcccttccgagagtgtctggcccagatcttcctgtccgaccacaccgcccccgagggtgagcgagagtccattgcctgcctcattgccgatggtctgtggaacttcctcggtgctgccgtctacaacttcaagctccccatgattgttctgcgaaccggtaacatgtccaacattgttgccaacgtcaagctcccctgcttcatcgagaagggctactttgaccacaccaaggaaggctccaagctcgaggctgccgtccccgagttccccaccatcaagttcaaggacattctcaagacctacggctccaaccccaaggccatctgtgagactctgaccgctctgctcaaggagatgcgagcttcttccggtgtcatctggaactcctgcaaggagctcgagcagtccgagctccagatgatctgcaaggagttccccgtcccccacttcctcatcggtcctctgcacaagtacttccccgcctcttcttcttctctcgttgcccacgacccctcttccatctcttggctcaactccaaggctcccaactccgtcctctacgtttcttttggctccatctcctccatggacgaggctgagttcctcgagactgcctggggtctggccaactccatgcagcagttcctgtgggttgtccgacccggctccgtccgaggttcccagtggctcgagtctctgcccgatggtttcattgacaagctcgacggccgaggccacattgtcaagtgggctccccagcaagaggttctcgcccaccaggccaccggtggtttctggacccactgtggctggaactccactctcgagtccatgtgcgagggtgtccccatgatctgctcccacggtatcatggaccagcccatcaacgcccgatacgtcaccgatgtctggaaggtcggtatcgagctcgagaagggctttgactccgaggagatcaagatggccatccgacgactcatggtcgataaagagggccaggagatccgagagcgatcttctcgactcaaggagtctctgtccaactgtctcaagcagggtggttcctcccacgactccgtcgagtctctggtcgaccacattctcagcttc

SEQ ID NO: 176 - DNA, 1380 bp, Arabidopsis thaliana
atggaggagcgaaagggccgacgaatcatcatgttccctctgcccttccccggccacttcaaccccatgatcgagctcgctggtatcttccaccaccgaggcttctccgtcaccatcctccacacctcctacaacttccccgacccctctcgacacccccacttcaccttccgaaccatctcccacaacaaggaaggcgaagaggaccccctgtcccagtccgagacttcttccatggacctcattgttctcgtccgacgactcaagcagcgatacgctgagcccttccgaaagtccgttgctgctgaggtcggtggtggtgagactgtctgctgcctcgtttccgatgccatctggggtaagaacaccgaggttgttgccgaggagattggtgtccgacgagttgtcctccgaaccggtggtgcctcttctttctgcgcctttgctgctttccctctgctccgagacaagggctacctccccatccaggactcccgactcgacgagcccgtcaccgagctgccccctctcaaggtcaaggatctgcccgtcatggagactaacgagcccgaggagctctaccgagttgtcaacgacatggtcgagggtgccaagtcctcttccggtgtcatctggaacacctttgaggatctcgagcgactctctctcatgaactgctcctccaagctccaggtccccttcttccccatcggtcccttccacaagtactccgaggaccccacccccaagaccgagaacaaggaagataccgactggctcgacaagcaggacccccagtccgttgtctacgcctcttttggctctctcgccgccatcgaggagaaggagttcctcgagattgcctggggtctgcgaaactccgagcgacccttcctgtgggttgtccgacccggctccgtccgaggcaccgagtggctcgagtctctgcccctcggcttcatggagaacattggtgacaagggcaagatcgtcaagtgggccaaccagctcgaggttctggcccaccccgccatcggtgccttctggacccactgtggctggaactccactctcgagtccatctgtgagggtgtccccatgatctgcacctcttgtttcaccgaccagcacgtcaacgcccgatacattgtcgatgtctggcgagtcggtatgctgctcgagcgatccaagatggagaagaaggagattgagaaggtcctccgatccgtcatgatggagaagggtgacggtctgcgagagcgatctctcaagctcaaggagcgagccgacttctgcctctccaaggacggctcctcctccaagtacctcgacaagcttgtctcccacgttctgtcttttgactcctacgcctttgcatcc

SEQ ID NO: 177 - DNA, 2139 bp, Gibberella fujikuroi
atggctgagctcgacactctcgacattgttgttctcggtgtcatcttcctcggtaccgttgcctacttcaccaagggtaagctgtggggtgtcaccaaggacccctacgccaacggctttgctgctggtggtgcctccaagcccggccgaacccgaaacattgttgaggccatggaggagtccggcaagaactgtgttgttttctacggctcccagaccggcaccgccgaggactacgcctctcgactggccaaggaaggcaagtctcgattcggtctgaacaccatgatcgctgatctcgaggactacgactttgacaacctggacaccgtcccctccgacaacatcgtcatgtttgtcctggccacctacggtgagggtgagcccaccgacaacgccgtcgacttctacgagttcatcaccggtgaggacgcttctttcaacgagggtaacgaccctcctctcggcaacctcaactacgttgccttcggtctgggcaacaacacctacgagcactacaactccatggtccgaaacgtcaacaaggctctcgagaagctcggcgcccaccgaatcggtgaggctggtgagggtgacgacggtgccggtaccatggaggaagatttcctggcctggaaggaccccatgtgggaggctctcgccaagaagatgggcctcgaggagcgagaggccgtctacgagcccatctttgccatcaacgagcgagatgatctcacccccgaggccaacgaggtctacctcggtgagcccaacaagctccacctcgagggtaccgccaagggccccttcaactcccacaacccctacattgcccccattgctgagtcctacgagctgttctccgccaaggaccgaaactgtctgcacatggagattgacatctccggctccaacctcaagtacgagactggtgaccacatcgccatctggcccaccaaccccggtgaagaggtcaacaagttcctcgacatcctcgatctctccggcaagcagcactctgttgtcaccgtcaaggctctcgagcccaccgccaaggtccccttccccaaccccaccacctacgacgccatcctgcgataccacctcgagatctgtgcccccgtttctcgacagttcgtttccactctggctgcctttgcccccaacgacgacatcaaggccgagatgaaccgactcggctccgacaaggactacttccacgagaaaaccggtcctcactactacaacattgctcgattcctggcttctgtctccaagggtgagaagtggaccaagatccccttctccgccttcattgagggtctgaccaagctccagccccgatactactccatctcttcttcttctctcgtccagcccaagaagatctccatcaccgctgttgtcgagtcccagcagatccccggccgagatgaccccttccgaggtgttgccaccaactacctcttcgccctcaagcagaagcagaacggtgaccccaaccccgctcccttcggtcagtcttacgagctcaccggcccccgaaacaagtacgacggtatccacgtccccgtccacgtccgacactccaacttcaagctcccctccgaccccggcaagcccatcatcatgattggccccggtactggtgttgctcccttccgaggctttgtccaggagcgagccaagcaggctcgagatggtgtcgaggtcggtaagactctgctcttcttcggctgccgaaagtccaccgaggacttcatgtaccagaaggagtggcaggagtacaaagaggctctcggtgacaagttcgagatgatcaccgccttctcccgagagggctccaagaaggtctacgtccagcaccgactcaaggagcgatccaaggaagtctccgacctcctctcccagaaggcctacttctacgtctgcggtgacgccgcccacatggcccgagaggtcaacaccgttctggcccagatcattgccgagggccgaggtgtctccgaggccaagggcgaggagattgtcaagaacatgcgatctgccaaccagtaccaggtctgctccgactttgtcaccctccactgcaaggagactacttacgccaactccgagctccaggaagatgtctggtct

SEQ ID NO: 178 - DNA, 2076 bp, Arabidopsis thaliana
atgacctctgctctctacgcctccgatctcttcaagcagctcaagtccatcatgggtaccgactccctgtccgacgatgtcgttctggtcattgccaccacctctctggctctggtcgccggtttcgttgtcctcctctggaagaaaaccaccgctgaccgatccggcgagctcaagcccctcatgatccccaagtctctcatggccaaggacgaggacgacgatctcgatctcggttccggcaagacccgagtctccatcttctttggcacccagaccggtaccgccgagggtttcgccaaggctctctccgaggagatcaaggcccgatacgagaaggccgccgtcaaggtcatcgacctcgacgactacgctgctgacgacgaccagtacgaggagaagctcaagaaggagactctcgccttcttctgtgtcgccacctacggtgacggcgagcccaccgacaacgccgcccgattctacaagtggttcaccgaggagaacgagcgagacatcaagctccagcagctggcctacggtgttttcgccctcggcaaccgacagtacgagcacttcaacaagatcggtattgtcctcgacgaggagctctgcaagaagggtgccaagcgactcattgaggttggtctgggtgatgatgaccagtccattgaggacgacttcaacgcctggaaggagtctctgtggtccgagctcgacaagctgctcaaggacgaggacgacaagtccgttgccaccccctacaccgccgtcatccccgagtaccgagtcgtcacccacgacccccgattcaccacccagaagtccatggagtccaacgttgccaacggtaacaccaccattgacatccaccacccctgccgagtcgacgttgccgtccagaaggagctccacacccacgagtccgaccgatcttgtatccacctcgagtttgacatctcccgaaccggtatcacctacgagactggtgaccacgttggtgtctacgccgagaaccacgttgagattgtcgaggaagctggtaagctgctcggccactctctcgacctcgttttctccatccacgccgacaaagaggacggctctcccctcgagtccgctgttccccctcccttccccggcccctgcactctcggcaccggtctggcccgatacgctgacctcctcaaccctccccgaaagtccgctctggttgctctcgccgcctacgccaccgagccctccgaggccgagaagctcaagcacctgacctcccccgacggcaaggacgagtactcccagtggatcgttgcttcccagcgatctctgctcgaggtcatggccgccttcccctctgccaagccccctctgggtgttttctttgccgccattgctccccgactccagccccgatactactccatctcctcctctccccgactcgccccctctcgagtccacgtcacctctgctctcgtctacggtcccactcccactggccgaatccacaagggtgtctgctccacctggatgaagaacgccgtccccgctgagaagtcccacgagtgctccggtgctcccatcttcatccgagcctccaacttcaagctcccctccaacccctccacccccattgtcatggtcggccccggtactggtctggcccccttccgaggcttcctccaggagcgaatggctctcaaggaagatggtgaggagctcggctcttctctgctcttctttggctgccgaaaccgacagatggacttcatctacgaggacgagctcaacaactttgtcgaccagggtgtcatctccgagctcatcatggccttctcccgagagggtgcccagaaggagtacgtccagcacaagatgatggagaaggccgcccaggtctgggatctcatcaaggaagagggctacctctacgtctgtggtgacgccaagggcatggcccgagatgtccaccgaactctgcacaccattgtccaggagcaggaaggtgtctcttcctccgaggctgaggccattgtcaagaagctgcagaccgagggccgatacctgcgagatgtatgg

SEQ ID NO: 179 - DNA, 2133 bp, Arabidopsis thaliana
atgtcctcctcttcttcttcttccacctccatgattgatctcatggctgccatcatcaagggtgagcccgtcattgtctccgaccccgccaacgcctccgcctacgagtccgttgctgccgagctgtcctccatgctcatcgagaaccgacagtttgccatgatcgtcaccacctccattgctgttctcattggctgcattgtcatgctcgtctggcgacgatctggctccggtaactccaagcgagtcgagcccctcaagcccctggtcatcaagccccgagaagaggagatcgacgacggccgaaagaaggtcaccatcttctttggcacccagaccggtactgctgagggcttcgccaaggctctcggtgaggaagccaaggctcgatacgaaaagacccgattcaagattgtcgacctcgatgattacgctgccgatgacgacgagtacgaggagaagctcaagaaagaggacgttgccttcttcttcctcgccacctacggtgacggtgagcccaccgacaacgctgcccgattctacaagtggttcaccgagggtaacgaccgaggcgagtggctcaagaacctcaagtacggtgttttcggtctgggcaaccgacagtacgagcacttcaacaaggttgccaaggttgtcgacgacatcctcgtcgagcagggtgcccagcgactcgtccaggtcggcctcggtgatgatgaccagtgcatcgaggacgacttcactgcctggcgagaggctctgtggcccgagctcgacaccattctgcgagaggaaggtgacaccgccgttgccaccccctacaccgccgccgtcctcgagtaccgagtctccatccacgactccgaggatgccaagttcaacgacatcaacatggccaacggtaacggctacaccgtctttgacgcccagcacccctacaaggccaacgtcgccgtcaagcgagagctccacacccccgagtccgaccgatcttgtatccacctcgagtttgacattgctggttccggtctgacctacgagactggtgaccacgttggtgtcctctgtgacaacctgtccgagactgtcgacgaggctctgcgactcctcgacatgtcccccgacacttacttctctctgcacgccgagaaagaggacggtactcccatctcttcttctctgccccctcccttccctccctgcaacctgcgaaccgctctgacccgatacgcctgcctcctctcttctcccaagaagtctgctctcgttgctctggccgcccacgcctccgaccccaccgaggctgagcgactcaagcacctcgcctctcccgctggcaaggacgagtactccaagtgggttgtcgagtcccagcgatctctgctcgaggtcatggccgagttcccctccgccaagccccctctcggtgttttcttcgccggtgttgctccccgactccagccccgattctactccatctcctcttcccccaagatcgccgagactcgaatccacgttacctgtgctctggtctacgagaagatgcccaccggccgaatccacaagggtgtctgctccacctggatgaagaacgccgttccctacgagaagtccgagaactgttcctctgctcccatctttgtccgacagtccaacttcaagctcccctccgactccaaggtccccatcatcatgattggccccggtaccggcctcgcccccttccgaggcttcctgcaggagcgactcgccctcgtcgagtccggtgtcgagctcggcccctccgtcctcttctttggctgccgaaaccgacgaatggacttcatctacgaagaggagctccagcgattcgtcgagtccggtgctctcgccgagctctccgttgccttctcccgagagggtcccaccaaggagtacgtccagcacaagatgatggacaaggcctccgacatctggaacatgatctcccagggcgcctacctctacgtctgcggtgacgccaagggtatggcccgagatgtccaccgatctctgcacaccattgcccaggagcagggctccatggactccaccaaggccgagggtttcgtcaagaacctccagacctccggccgatacctccgagatgtctgg

SEQ ID NO: 180 - DNA, 1575 bp, Gibberella fujikuroi
atgtccaagtccaactccatgaactccacctcccacgagactctcttccagcagctcgttctcggcctcgaccgaatgcccctcatggacgtccactggctcatctacgttgcctttggtgcctggctctgctcctacgtcatccacgttctgtcctcttcctccactgtcaaggtccccgtcgtcggttaccgatccgttttcgagcccacctggctcctccgactgcgattcgtctgggagggtggttccatcattggccagggctacaacaagttcaaggactccatcttccaggtccgaaagctcggtaccgacattgtcatcatccctcccaactacattgacgaggtccgaaagctctcccaggacaagacccgatccgtcgagcccttcatcaacgactttgccggccagtacacccgaggtatggtctttctgcagtccgatctccagaaccgagtcatccagcagcgactcacccccaagcttgtctctctcaccaaggtcatgaaggaagagctcgactacgctctgaccaaggagatgcccgacatgaagaacgacgagtgggttgaggtcgacatctcttccatcatggtccgactcatctctcgaatctccgcccgagttttcctcggccccgagcactgccgaaaccaggagtggctcaccaccaccgccgagtactccgagtctctcttcatcaccggcttcatcctccgagttgtcccccacattctccgacccttcattgctcctctgctgccctcttaccgaaccctgctgcgaaacgtttcttccggccgacgagtcattggtgatatcatccgatcccagcagggtgacggtaacgaggacatcctctcttggatgcgagatgctgccactggtgaggagaagcagatcgacaacattgcccagcgaatgctcattctgtctctcgcctccatccacaccaccgccatgaccatgacccacgccatgtacgatctgtgtgcctgccccgagtacattgagcccctccgagatgaggtcaagtccgtcgttggtgcttctggctgggacaagaccgctctcaaccgattccacaagctcgactctttcctcaaggagtcccagcgattcaaccccgttttcctgctcaccttcaaccgaatctaccaccagtccatgaccctctccgatggtaccaacatcccctccggtacccgaattgctgtcccctctcacgccatgctccaggactccgcccacgtccccggtcccactcctcccactgagttcgacggtttccgatactccaagatccgatccgactccaactacgcccagaagtacctcttctccatgaccgactcttccaacatggcctttggctacggtaagtacgcctgccccggccgattctacgcctccaacgagatgaagctgactctggccattctgctcctccagtttgagttcaagctccccgacggtaagggccgaccccgaaacatcaccatcgactccgacatgatccccgacccccgagctcgactctgtgtccgaaagcgatctctgcgtgacgag

SEQ ID NO: 181 - DNA, 1419 bp, Stevia rebaudiana
atggccacctccgactccattgtcgacgaccgaaagcagctgcacgttgccaccttcccctggctcgcctttggccacattctgccctacctccagctctccaagctcattgctgagaagggccacaaggtttctttcctgtccaccacccgaaacatccagcgactctcctcccacatctctcctctcatcaacgttgtccagctcaccctcccccgagtccaggagctccccgaggatgccgaggccaccactgatgtccaccccgaggacatcccctacctcaagaaggcctccgacggtctgcagcccgaggtcacccgattcctcgagcagcactctcccgactggatcatctacgactacacccactactggctcccctccattgctgcttctctcggtatctctcgagcccacttctccgtcaccaccccctgggccattgcttacatgggcccctctgctgacgccatgatcaacggttccgacggccgaaccaccgtcgaggatctcaccacccctcccaagtggttccccttccccaccaaggtctgctggcgaaagcacgatctcgcccgactcgtcccctacaaggcccccggtatctccgacggttaccgaatgggtctggttctcaagggctccgactgtctgctctccaagtgctaccacgagtttggtacccagtggctccccctgctcgagactctgcaccaggtccccgttgtccccgtcggtctgctccctcccgagatccccggtgacgagaaggacgagacttgggtttccatcaagaagtggctcgacggcaagcagaagggctccgtcgtctacgttgctctcggctccgaggttcttgtctcccagactgaggtcgtcgagctcgccctcggtctggagctctccggtctgcccttcgtctgggcctaccgaaagcccaagggtcccgccaagtccgactccgtcgagctccccgacggtttcgtcgagcgaactcgagatcgaggtctggtctggacctcttgggctccccagctccgaatcctctcccacgagtccgtctgcggtttcctgacccactgtggttccggctccattgtcgagggcctcatgttcggccaccccctcatcatgctgcccatcttcggtgaccagcccctcaacgcccgactcctcgaggacaagcaggtcggtatcgagatcccccgaaacgaagaggacggctgcctcaccaaggagtctgttgcccgatctctgcgatctgttgttgtcgagaaagagggtgagatctacaaggccaacgcccgagagctctccaagatctacaacgacaccaaggtcgagaaggagtacgtttcccagtttgtcgactacctcgagaagaacgcccgagctgtcgccattgaccacgagagt

SEQ ID NO: 182 - DNA, 2552 bp, Artificial sequence
  tCPS-cwpT
cccactagttataaagtcacaagtatctcagtatacccgtctaaccacacatttatcaccatgtgcaaggctgtttccaaggagtactccgatctgctccagaaggacgaggcctctttcaccaagtgggacgacgacaaggtcaaggaccacctcgacaccaacaagaacctctaccccaacgacgagatcaaggagtttgtcgagtccgtcaaggccatgttcggctccatgaacgacggcgagattaatgtctctgcttacgacaccgcctgggttgctctggtccaggatgtcgacggttccggctctcctcagttcccttcctctctcgagtggatcgccaacaaccagctgtccgacggttcttggggtgaccacctgctcttctctgctcacgaccgaatcatcaacaccctggcctgtgtcattgctctgacctcttggaacgtccacccctccaagtgcgagaagggtctgaacttcctccgagagaacatctgcaagctcgaggacgagaacgccgagcacatgcccattggcttcgaggtcaccttcccctctctgattgacattgccaagaagctcaacattgaggtccccgaggacacccccgctctcaaggagatctacgctcgacgagacatcaagctcaccaagatccccatggaggttctccacaaggtccccaccactctcctccactctctcgagggtatgcccgatctcgagtgggagaagctgctcaagctgcagtgcaaggacggctctttcctcttctccccctcttccactgccttcgccctcatgcagaccaaggacgagaagtgtctccagtacctcaccaacattgtcaccaagttcaacggtggtgtccccaacgtctaccccgttgacctctttgagcacatctgggttgttgaccgactccagcgactcggtatcgcccgatacttcaagtccgagatcaaggactgtgtcgagtacatcaacaagtactggaccaagaacggtatctgctgggcccgaaacacccacgtccaggacattgacgacaccgccatgggcttccgagttctgcgagcccacggctacgatgtcacccccgatgtctttcgacagtttgagaaggacggcaagtttgtctgtttcgccggtcagtccacccaggccgtcaccggtatgttcaacgtctaccgagcttctcagatgctcttccccggtgagcgaatcctcgaggacgccaagaagttctcctacaactacctcaaggagaagcagtccaccaacgagctgctcgacaagtggatcattgccaaggatctgcccggtgaggttggctacgccctcgacatcccctggtacgcctctctgccccgactggagactcgatactacctcgagcagtacggtggtgaggacgatgtctggatcggtaagaccctgtaccgaatgggctacgtttccaacaacacctacctcgagatggccaagctcgactacaacaactacgttgccgtcctccagctcgagtggtacaccatccagcagtggtacgtcgacattggtatcgagaagttcgagtccgacaacatcaagtccgtccttgtctcctactacctcgctgctgcctccatcttcgagcccgagcgatccaaggagcgaattgcctgggccaagaccaccatcctcgtcgacaagatcacctccatcttcgactcctcccagtcctccaaggaagatatcaccgccttcattgacaagttccgaaacaagtcctcctccaagaagcactccatcaacggcgagccctggcacgaggtcatggttgctctcaagaaaactctccacggctttgccctcgacgctctgatgacccactctcaggacatccacccccagctccaccaggcctgggagatgtggctcaccaagctccaggacggtgttgatgtcactgctgagctcatggtccagatgatcaacatgaccgccggccgatgggtttccaaggagctcctcacccacccccagtaccagcgactctccactgtcaccaactctgtctgccacgacatcaccaagctccacaacttcaaggagaactccaccaccgtcgactccaaggtccaggagctggtccagctcgttttctccgacacccccgatgatctcgaccaggacatgaagcagaccttcctgactgtcatgaaaactttctactacaaggcctggtgcgaccccaacaccatcaacgaccacatctccaaggtctttgagattgtgatttaagttttttgatcaatgatccaatggctttcacatacccccccacgcctataattaaaacacagagaaatataatctaacttaataaatattacggagaatctttcgagtgttcagcagaaatatagccattgtaacaaaagccggctatcgaccgctttatcgaagaatatttcccgccccccagtggccaaacgatatcgaaacaaaagagctgaaatcatatccttcagtagtagtatagtcctgttatcacagcatca

SEQ ID NO: 183 - DNA, 2394 bp, Artificial sequence
  tKS
agatatacaagcaatgtcactctccttcgtactcgtacatacaacacaactacattcaaaatgacctcccacggcggccagaccaaccccaccaacctcatcattgacaccaccaaggagcgaatccagaagcagttcaagaacgtcgagatctccgtttcctcctacgacaccgcctgggtcgccatggtcccctctcccaactcccccaagtctccctgcttccccgagtgtctcaactggctcatcaacaaccagctcaacgacggctcttggggtctggtcaaccacacccacaaccacaaccaccccctcctcaaggactctctctcttccactctcgcctgcattgttgctctcaagcgatggaacgttggcgaggaccagatcaacaagggtctgtctttcattgagtccaacctcgcctccgccaccgagaagtcccagccctcccccattggctttgatatcatcttccccggtctgctcgagtacgccaagaacctcgatatcaacctgctctccaagcagaccgacttctctctcatgctgcacaagcgagagctcgagcagaagcgatgccactccaacgagatggacggctacctggcctacatttccgagggtctgggtaacctctacgactggaacatggtcaagaagtaccagatgaagaacggttccgttttcaactccccctctgccaccgctgctgccttcatcaaccaccagaaccccggctgtctcaactacctcaactctctgctcgacaagtttggtaacgccgtccccactgtctacccccacgatctcttcatccgactctccatggtcgacaccattgagcgactcggtatttcccaccacttccgagtcgagatcaagaacgttctcgatgagacttaccgatgctgggttgagcgagatgagcagatcttcatggacgttgtcacctgtgctctggccttccgactcctccgaatcaacggttacgaggtttcccccgaccccctcgccgagatcaccaacgagctggctctcaaggacgagtacgccgccctcgagacttaccacgcttctcacattctgtaccaagaggatctgtcctccggcaagcagattctcaagtccgccgacttcctcaaggagatcatctccactgactccaaccgactctccaagctcatccacaaggaagtcgagaacgctctcaagttccccatcaacaccggtctggagcgaatcaacacccgacgaaacatccagctctacaacgtcgacaacacccgaattctcaagaccacctaccactcttccaacatctccaacaccgactacctgcgactcgccgtcgaggacttctacacctgccagtccatctaccgagaggagctcaagggtctggagcgatgggttgtcgagaacaagctcgaccagctcaagtttgcccgacaaaagactgcctactgctacttctccgttgctgccaccctctcttctcccgagctctccgacgcccgaatctcttgggccaagaacggtatcctgaccactgttgtcgacgacttctttgacattggtggcaccattgacgagctgaccaacctcatccagtgcgtcgagaagtggaacgtcgacgttgacaaggactgttgttccgagcacgtccgaatcctcttcctggctctcaaggacgccatctgctggatcggtgacgaggccttcaagtggcaggctcgagatgtcacttcccacgtcatccagacctggctcgagctcatgaactccatgctgcgagaggccatctggacccgagatgcctacgtccccaccctcaacgagtacatggagaacgcctacgtcagctttgctctcggtcccattgtcaagcccgccatctactttgtcggtcccaagctgtccgaggagattgtcgagtcctccgagtaccacaacctcttcaagctcatgtccacccagggccgactcctcaacgatatccactccttcaagcgagagttcaaggaaggtaagctcaacgccgttgctctgcacctgtccaacggtgagtccggcaaggtcgaggaagaggtcgtcgaggagatgatgatgatgatcaagaacaagcgaaaggagctcatgaagctcatcttcgaggagaacggctccattgtcccccgagcctgcaaggacgccttctggaacatgtgccacgtcctcaacttcttctacgccaacgacgacggtttcaccggcaacaccattctcgacaccgtcaaggacatcatctacaaccctctggttctggtcaacgagaacgaggagcagaggtaactatccgaagatcaagagcgaagcaagttgtaagtccaggacatgtttcccgcccacgcg

SEQ ID NO: 184 - DNA, 2979 bp, Artificial sequence
  CPSKS
cccactagttataaagtcacaagtatctcagtatacccgtctaaccacacatttatcaccatgcccggcaagattgagaacggtacccccaaggacctcaagaccggcaacgacttcgtttccgctgccaagtctctgctcgaccgagccttcaagtcccaccactcctactacggtctgtgctccacttcctgccaggtctacgacaccgcctgggttgccatgatccccaagacccgagacaacgtcaagcagtggctcttccccgagtgtttccactacctgctcaagacccaggctgctgacggctcttggggctctctgcccaccacccagaccgccggtatcctcgacactgcctccgccgttctggctctgctctgccacgcccaggagcctctgcagatcctcgatgtctcccccgatgagatgggtctgcgaatcgagcacggtgtcacttctctcaagcgacagctcgccgtctggaacgacgttgaggacaccaaccacattggtgtcgagttcatcatccccgctctgctctccatgctcgagaaggagctcgatgtcccctccttcgagttcccttgccgatccattctggagcgaatgcacggcgagaagctcggtcactttgatctcgagcaggtctacggcaagccctcttctctgctgcactctctcgaggccttcctcggcaagctcgatttcgaccgactctcccaccacctctaccacggctccatgatggcctccccctcttccaccgccgcctacctcattggtgccaccaagtgggacgacgaggccgaggactacctccgacacgtcatgcgaaacggtgccggccacggtaacggtggtatctctggtaccttccccaccacccactttgagtgctcctggatcattgccactctcctcaaggtcggtttcactctcaagcagattgacggtgacggtctgcgaggcctctccaccattctcctcgaggctctgcgtgacgagaacggtgtcattggcttcgctccccgaaccgccgacgttgatgacactgccaaggctctgctggctctgtctctggtcaaccagcccgtttcccccgacatcatgatcaaggttttcgagggtaaggaccacttcaccacctttggctccgagcgagatccctctctgacctccaacctccacgttctcctctctctgctcaagcagtccaacctgtctcagtaccacccccagatcctcaagaccactctcttcacctgtcgatggtggtggggctccgaccactgtgtcaaggacaagtggaacctctcccacctctaccccaccatgctcctcgtcgaggccttcaccgaggttctgcacctcatcgacggtggtgagctctcctctctgtttgacgagtctttcaagtgcaagatcggtctgtccatcttccaggccgttctccgaatcatcctcacccaggacaacgacggctcttggcgaggctaccgagagcagacctgttacgccattctcgccctcgtccaggcccgacacgtctgtttcttcacccacatggtcgaccgactccagtcctgtgtcgaccgaggtttctcttggctcaagtcttgctccttccactctcaggacctcacctggacctccaagaccgcttacgaggttggtttcgttgccgaggcctacaagctcgctgctctccagtccgcctctctcgaggtccccgctgccaccatcggccactccgtcacctctgctgtcccctcctccgatctcgagaagtacatgcgactcgtccgaaagaccgctctgttctctcccctcgatgagtggggtctgatggcctccatcatcgagtcctccttctttgtccccctcctccaggcccagcgagttgagatctacccccgagacaacatcaaggtcgacgaggacaagtacctctccatcatccccttcacctgggttggctgcaacaaccgatctcgaacctttgcctccaaccgatggctctacgacatgatgtacctgtctctgctcggctaccagaccgacgagtacatggaggccgttgccggccccgtctttggtgatgtctctctgctgcaccagaccatcgacaaggtcattgacaacaccatgggtaacctggcccgagccaacggtaccgtccactccggcaacggtcaccagcacgagtcccccaacattggccaggtcgaggacaccctcactcgatttaccaactccgtcctcaaccacaaggacgtcctcaactcctcctcctccgaccaggacaccctccgacgagagttccgaaccttcatgcacgcccacatcacccagatcgaggacaactcccgattctccaagcaggcttcttccgacgccttctcctcccccgagcagtcctacttccagtgggtcaactccactggtggttcccacgttgcctgcgcctactctttcgccttctccaactgcctcatgtccgccaacctcctccagggtaaggacgccttcccttccggtacccagaagtacctcatctcctccgtcatgcgacacgccaccaacatgtgccgaatgtacaacgatttcggttccatcgcccgagacaacgccgagcgaaacgtcaactccatccactttcccgagttcactctctgtaacggtacctcccagaacctcgacgagcgaaaggagcgactcctcaagattgctacttacgagcagggctacctcgaccgagctctcgaggctctggagcgacagtcccgagatgatgctggtgaccgagccggctccaaggacatgcgaaagctcaagattgtcaagctcttctgtgacgtcaccgacctctacgaccagctctacgtcatcaaggacctctcctcctccatgaaataactatccgaagatcaagagcgaagcaagttgtaagtccaggacatgtttcccgcccacgcg

SEQ ID NO: 185 - DNA, 1698 bp, Artificial sequence
  KAH4
ttgaatcttttttcttcttctcttctctatattcattcttgaattaaacacacatcaacaatggagtctctggttgtccacaccgtcaacgccatctggtgcattgtcattgtcggtatcttctccgtcggctaccacgtctacggccgagctgttgtcgagcagtggcgaatgcgacgatctctcaagctccagggtgtcaagggtcctcctccctccatcttcaacggtaacgtttccgagatgcagcgaatccagtccgaggccaagcactgctccggtgacaacatcatctcccacgactactcttcttctctgttcccccactttgaccactggcgaaagcagtacggccgaatctacacctactccactggcctcaagcagcacctctacatcaaccaccccgagatggtcaaggagctctcccagaccaacaccctcaacctcggccgaatcacccacatcaccaagcgactcaaccccattctcggtaacggtatcatcacctccaacggcccccactgggcccaccagcgacgaatcattgcctacgagttcacccacgacaagatcaagggtatggtcggtctgatggtcgagtccgccatgcccatgctcaacaagtgggaggagatggtcaagcgaggtggtgagatgggctgtgacatccgagtcgacgaggacctcaaggatgtctccgctgacgtcattgccaaggcctgtttcggctcttccttctccaagggcaaggccatcttctccatgatccgagatctgctcaccgccatcaccaagcgatccgtcctcttccgattcaacggtttcaccgacatggttttcggctccaagaagcacggtgacgttgacattgacgctctcgagatggagctcgagtcctccatctgggagactgtcaaggagcgagagattgagtgcaaggacacccacaagaaggacctcatgcagctcattctcgagggtgccatgcgatcttgtgacggtaacctgtgggacaagtctgcttaccgacgattcgttgtcgacaactgcaagtccatctactttgccggccacgactccaccgccgtttccgtttcttggtgcctcatgctgctcgctctcaacccctcttggcaggtcaagatccgagatgagattctgtcctcctgcaagaacggtatccccgacgccgagtccatccccaacctcaagaccgtcaccatggtcatccaggagactatgcgactctaccctcccgctcccattgtcggccgagaggcctccaaggacattcgactcggtgatctggttgtccccaagggtgtctgtatctggaccctcatccccgctctgcaccgagatcccgagatctggggtcccgacgccaacgacttcaagcccgagcgattctccgagggtatctccaaggcctgcaagtacccccagtcctacatcccctttggcctcggcccccgaacctgtgtcggcaagaactttggtatgatggaggtcaaggtcctcgtttctctgattgtctccaagttctccttcactctgtctcccacctaccagcactctccctcccacaagctgctcgtcgagccccagcacggtgttgtcatccgagttgtataaacttcgagctaatccagtagcttacgttacccaggggcaggtcaactggctagccacgag

SEQ ID NO: 186 - DNA, 1698 bp, Artificial sequence
  KOgib
cacacccgaaatcgttaagcatttccttctgagtataagaatcattcgctagccacaaaaatgtccaagtccaactccatgaactccacctcccacgagactctcttccagcagctcgttctcggcctcgaccgaatgcccctcatggacgtccactggctcatctacgttgcctttggtgcctggctctgctcctacgtcatccacgttctgtcctcttcctccactgtcaaggtccccgtcgtcggttaccgatccgttttcgagcccacctggctcctccgactgcgattcgtctgggagggtggttccatcattggccagggctacaacaagttcaaggactccatcttccaggtccgaaagctcggtaccgacattgtcatcatccctcccaactacattgacgaggtccgaaagctctcccaggacaagacccgatccgtcgagcccttcatcaacgactttgccggccagtacacccgaggtatggtctttctgcagtccgatctccagaaccgagtcatccagcagcgactcacccccaagcttgtctctctcaccaaggtcatgaaggaagagctcgactacgctctgaccaaggagatgcccgacatgaagaacgacgagtgggttgaggtcgacatctcttccatcatggtccgactcatctctcgaatctccgcccgagttttcctcggccccgagcactgccgaaaccaggagtggctcaccaccaccgccgagtactccgagtctctcttcatcaccggcttcatcctccgagttgtcccccacattctccgacccttcattgctcctctgctgccctcttaccgaaccctgctgcgaaacgtttcttccggccgacgagtcattggtgatatcatccgatcccagcagggtgacggtaacgaggacatcctctcttggatgcgagatgctgccactggtgaggagaagcagatcgacaacattgcccagcgaatgctcattctgtctctcgcctccatccacaccaccgccatgaccatgacccacgccatgtacgatctgtgtgcctgccccgagtacattgagcccctccgagatgaggtcaagtccgtcgttggtgcttctggctgggacaagaccgctctcaaccgattccacaagctcgactctttcctcaaggagtcccagcgattcaaccccgttttcctgctcaccttcaaccgaatctaccaccagtccatgaccctctccgatggtaccaacatcccctccggtacccgaattgctgtcccctctcacgccatgctccaggactccgcccacgtccccggtcccactcctcccactgagttcgacggtttccgatactccaagatccgatccgactccaactacgcccagaagtacctcttctccatgaccgactcttccaacatggcctttggctacggtaagtacgcctgccccggccgattctacgcctccaacgagatgaagctgactctggccattctgctcctccagtttgagttcaagctccccgacggtaagggccgaccccgaaacatcaccatcgactccgacatgatccccgacccccgagctcgactctgtgtccgaaagcgatctctgcgtgacgagtaagctatttacagcatgtgtaatgaggaatataacgttgattgaattgtttgtgaaaaatgt

SEQ ID NO: 187 - DNA, 2262 bp, Artificial sequence
  CPR1
cgtccatatatatctatgctgcgtcgtccttttcgtgacatcaccaaaacacatacaaaaatggctgagctcgacactctcgacattgttgttctcggtgtcatcttcctcggtaccgttgcctacttcaccaagggtaagctgtggggtgtcaccaaggacccctacgccaacggctttgctgctggtggtgcctccaagcccggccgaacccgaaacattgttgaggccatggaggagtccggcaagaactgtgttgttttctacggctcccagaccggcaccgccgaggactacgcctctcgactggccaaggaaggcaagtctcgattcggtctgaacaccatgatcgctgatctcgaggactacgactttgacaacctggacaccgtcccctccgacaacatcgtcatgtttgtcctggccacctacggtgagggtgagcccaccgacaacgccgtcgacttctacgagttcatcaccggtgaggacgcttctttcaacgagggtaacgaccctcctctcggcaacctcaactacgttgccttcggtctgggcaacaacacctacgagcactacaactccatggtccgaaacgtcaacaaggctctcgagaagctcggcgcccaccgaatcggtgaggctggtgagggtgacgacggtgccggtaccatggaggaagatttcctggcctggaaggaccccatgtgggaggctctcgccaagaagatgggcctcgaggagcgagaggccgtctacgagcccatctttgccatcaacgagcgagatgatctcacccccgaggccaacgaggtctacctcggtgagcccaacaagctccacctcgagggtaccgccaagggccccttcaactcccacaacccctacattgcccccattgctgagtcctacgagctgttctccgccaaggaccgaaactgtctgcacatggagattgacatctccggctccaacctcaagtacgagactggtgaccacatcgccatctggcccaccaaccccggtgaagaggtcaacaagttcctcgacatcctcgatctctccggcaagcagcactctgttgtcaccgtcaaggctctcgagcccaccgccaaggtccccttccccaaccccaccacctacgacgccatcctgcgataccacctcgagatctgtgcccccgtttctcgacagttcgtttccactctggctgcctttgcccccaacgacgacatcaaggccgagatgaaccgactcggctccgacaaggactacttccacgagaaaaccggtcctcactactacaacattgctcgattcctggcttctgtctccaagggtgagaagtggaccaagatccccttctccgccttcattgagggtctgaccaagctccagccccgatactactccatctcttcttcttctctcgtccagcccaagaagatctccatcaccgctgttgtcgagtcccagcagatccccggccgagatgaccccttccgaggtgttgccaccaactacctcttcgccctcaagcagaagcagaacggtgaccccaaccccgctcccttcggtcagtcttacgagctcaccggcccccgaaacaagtacgacggtatccacgtccccgtccacgtccgacactccaacttcaagctcccctccgaccccggcaagcccatcatcatgattggccccggtactggtgttgctcccttccgaggctttgtccaggagcgagccaagcaggctcgagatggtgtcgaggtcggtaagactctgctcttcttcggctgccgaaagtccaccgaggacttcatgtaccagaaggagtggcaggagtacaaagaggctctcggtgacaagttcgagatgatcaccgccttctcccgagagggctccaagaaggtctacgtccagcaccgactcaaggagcgatccaaggaagtctccgacctcctctcccagaaggcctacttctacgtctgcggtgacgccgcccacatggcccgagaggtcaacaccgttctggcccagatcattgccgagggccgaggtgtctccgaggccaagggcgaggagattgtcaagaacatgcgatctgccaaccagtaccaggtctgctccgactttgtcaccctccactgcaaggagactacttacgccaactccgagctccaggaagatgtctggtcttaaaattaacagatagtttgccggtgataattctcttaacctcccacactcctttgacataac

SEQ ID NO: 188 - DNA, 2256 bp, Artificial sequence
  CPR3
cgtccatatatatctatgctgcgtcgtccttttcgtgacatcaccaaaacacatacaaaaatgtcctcctcttcttcttcttccacctccatgattgatctcatggctgccatcatcaagggtgagcccgtcattgtctccgaccccgccaacgcctccgcctacgagtccgttgctgccgagctgtcctccatgctcatcgagaaccgacagtttgccatgatcgtcaccacctccattgctgttctcattggctgcattgtcatgctcgtctggcgacgatctggctccggtaactccaagcgagtcgagcccctcaagcccctggtcatcaagccccgagaagaggagatcgacgacggccgaaagaaggtcaccatcttctttggcacccagaccggtactgctgagggcttcgccaaggctctcggtgaggaagccaaggctcgatacgaaaagacccgattcaagattgtcgacctcgatgattacgctgccgatgacgacgagtacgaggagaagctcaagaaagaggacgttgccttcttcttcctcgccacctacggtgacggtgagcccaccgacaacgctgcccgattctacaagtggttcaccgagggtaacgaccgaggcgagtggctcaagaacctcaagtacggtgttttcggtctgggcaaccgacagtacgagcacttcaacaaggttgccaaggttgtcgacgacatcctcgtcgagcagggtgcccagcgactcgtccaggtcggcctcggtgatgatgaccagtgcatcgaggacgacttcactgcctggcgagaggctctgtggcccgagctcgacaccattctgcgagaggaaggtgacaccgccgttgccaccccctacaccgccgccgtcctcgagtaccgagtctccatccacgactccgaggatgccaagttcaacgacatcaacatggccaacggtaacggctacaccgtctttgacgcccagcacccctacaaggccaacgtcgccgtcaagcgagagctccacacccccgagtccgaccgatcttgtatccacctcgagtttgacattgctggttccggtctgacctacgagactggtgaccacgttggtgtcctctgtgacaacctgtccgagactgtcgacgaggctctgcgactcctcgacatgtcccccgacacttacttctctctgcacgccgagaaagaggacggtactcccatctcttcttctctgccccctcccttccctccctgcaacctgcgaaccgctctgacccgatacgcctgcctcctctcttctcccaagaagtctgctctcgttgctctggccgcccacgcctccgaccccaccgaggctgagcgactcaagcacctcgcctctcccgctggcaaggacgagtactccaagtgggttgtcgagtcccagcgatctctgctcgaggtcatggccgagttcccctccgccaagccccctctcggtgttttcttcgccggtgttgctccccgactccagccccgattctactccatctcctcttcccccaagatcgccgagactcgaatccacgttacctgtgctctggtctacgagaagatgcccaccggccgaatccacaagggtgtctgctccacctggatgaagaacgccgttccctacgagaagtccgagaactgttcctctgctcccatctttgtccgacagtccaacttcaagctcccctccgactccaaggtccccatcatcatgattggccccggtaccggcctcgcccccttccgaggcttcctgcaggagcgactcgccctcgtcgagtccggtgtcgagctcggcccctccgtcctcttctttggctgccgaaaccgacgaatggacttcatctacgaagaggagctccagcgattcgtcgagtccggtgctctcgccgagctctccgttgccttctcccgagagggtcccaccaaggagtacgtccagcacaagatgatggacaaggcctccgacatctggaacatgatctcccagggcgcctacctctacgtctgcggtgacgccaagggtatggcccgagatgtccaccgatctctgcacaccattgcccaggagcagggctccatggactccaccaaggccgagggtttcgtcaagaacctccagacctccggccgatacctccgagatgtctggtaaaattaacagatagtttgccggtgataattctcttaacctcccacactcctttgacataac

SEQ ID NO: 189 - DNA, 1566 bp, Artificial sequence
  UGT1
cccactagttataaagtcacaagtatctcagtatacccgtctaaccacacatttatcaccatggacgccatggccaccaccgagaagaagccccacgtcatcttcatccccttccccgcccagtcccacatcaaggccatgctcaagctcgcccagctcctccaccacaagggcctccagatcacctttgtcaacaccgacttcatccacaaccagttcctcgagtcctccggcccccactgtctggacggtgctcccggtttccgatttgagactatccccgatggtgtctcccactcccccgaggcctccatccccatccgagagtctctgctccgatccattgagactaacttcctcgaccgattcattgatctcgtcaccaagctccccgatcctcccacctgtatcatctccgacggtttcctgtccgttttcaccattgatgctgccaagaagctcggtatccccgtcatgatgtactggactctggctgcctgtggtttcatgggtttctaccacatccactctctgatcgagaagggctttgctcctctcaaggacgcctcctacctcaccaacggttacctcgacaccgtcattgactgggtccccggtatggagggtatccgactcaaggacttccccctcgactggtccaccgacctcaacgacaaggttctcatgttcaccaccgaggctccccagcgatcccacaaggtttcccaccacatcttccacaccttcgacgagctcgagccctccatcatcaagactctgtctctgcgatacaaccacatctacaccattggccccctccagctcctcctcgaccagatccccgaggagaagaagcagaccggtatcacctctctgcacggctactctctcgtcaaggaagagcccgagtgcttccagtggctccagtccaaggagcccaactccgttgtctacgtcaactttggctccaccaccgtcatgtctctcgaggacatgaccgagtttggctggggtctggccaactccaaccactacttcctgtggatcatccgatccaacctcgtcattggcgagaacgccgttctgcctcccgagctcgaggagcacatcaagaagcgaggcttcattgcctcttggtgctcccaggagaaggttctcaagcacccctccgtcggtggtttcctgacccactgcggctggggctccaccattgagtctctgtccgctggtgtccccatgatctgctggccctactcctgggaccagctcaccaactgccgatacatctgcaaggagtgggaggttggtctggagatgggtaccaaggtcaagcgagatgaggtcaagcgactcgtccaggagctcatgggcgagggtggtcacaagatgcgaaacaaggccaaggactggaaggagaaggcccgaattgccattgcccccaacggctcttcttctctcaacattgacaagatggtcaaggagatcactgttctcgctcgaaactaactatccgaagatcaagagcgaagcaagttgtaagtccaggacatgtttcccgcccacgcg

SEQ ID NO: 190 - DNA, 1503 bp, Artificial sequence
  UGT3
ttgaatcttttttcttcttctcttctctatattcattcttgaattaaacacacatcaacaatggccgagcagcagaagatcaagaagtctccccacgttctgctcatccccttccctctgcagggccacatcaaccccttcatccagttcggcaagcgactcatctccaagggtgtcaagaccactctggtcaccaccatccacaccctcaactccactctcaaccactccaacaccaccaccacctccatcgagatccaggccatctccgacggctgtgacgagggtggtttcatgtctgctggtgagtcttacctcgagactttcaagcaggtcggttccaagtctctggctgacctcatcaagaagctccagtccgagggtaccaccattgacgccatcatctacgactccatgaccgagtgggttctcgatgtcgccatcgagtttggtattgacggtggctccttcttcacccaggcctgtgtcgtcaactctctctactaccacgtccacaagggtctgatctctctgcccctcggcgagactgtctccgtccccggtttccccgttctgcagcgatgggagactcctctcattctccagaaccacgagcagatccagtccccctggtcccagatgctcttcggccagttcgccaacattgaccaggcccgatgggttttcaccaactccttctacaagctcgaggaagaggtcattgagtggacccgaaagatctggaacctcaaggtcattggccccaccctcccctccatgtacctcgacaagcgactcgatgacgacaaggacaacggtttcaacctctacaaggccaaccaccacgagtgcatgaactggctcgacgacaagcccaaggagtccgttgtctacgttgcctttggctctctggtcaagcacggccccgagcaggttgaggagatcacccgagctctgattgactccgatgtcaacttcctgtgggtcatcaagcacaaggaagagggtaagctccccgagaacctgtccgaggtcatcaagaccggcaagggcctcattgttgcctggtgcaagcagctcgacgttctcgcccacgagtccgtcggctgctttgtcacccactgcggtttcaactccaccctcgaggctatctctctcggtgtccccgttgttgccatgccccagttctccgaccagaccaccaacgccaagctcctcgatgagattctcggtgtcggtgtccgagtcaaggctgacgagaacggtattgtccgacgaggtaacctggcttcttgtatcaagatgatcatggaggaagagcgaggtgtcatcatccgaaagaacgccgtcaagtggaaggatctggccaaggttgctgtccacgagggtggctcttccgacaacgacattgtcgagtttgtctccgagctcatcaaggcctaaacttcgagctaatccagtagcttacgttacccaggggcaggtcaactggctagccacgag

SEQ ID NO: 191 - DNA, 1497 bp, Artificial sequence
  UGT4
cacacccgaaatcgttaagcatttccttctgagtataagaatcattcgctagccacaaaaatggagaacaagaccgagactaccgtccgacgacgacgacgaatcattctcttccccgtccccttccagggccacatcaaccccattctgcagctcgccaacgttctgtactccaagggcttctccatcaccatcttccacaccaacttcaacaagcccaagacctccaactacccccacttcactttccgattcatcctcgacaacgacccccaggacgagcgaatctccaacctgcccacccacggtcctctggctggtatgcgaatccccatcatcaacgagcacggtgctgacgagctccgacgagagctcgagctgctcatgctcgcctccgaagaggacgaggaagtctcctgtctgatcaccgatgctctgtggtactttgcccagtccgtcgccgactctctcaacctgcgacgactcgttctcatgacctcctctctgttcaacttccacgcccacgtttctctgccccagtttgacgagctcggttacctcgaccccgatgacaagacccgactcgaggagcaggcttccggtttccccatgctcaaggtcaaggacatcaagtccgcctactccaactggcagattctcaaggagattctcggcaagatgatcaagcagaccaaggcctcctccggtgtcatctggaactccttcaaggagctcgaggagtccgagctcgagactgtcatccgagagatccccgctccctctttcctcatccccctgcccaagcacctcaccgcttcctcctcttctctgctcgaccacgaccgaaccgtctttcagtggctcgaccagcagcccccttcctccgtcctctacgtttccttcggctccacctccgaggtcgacgagaaggacttcctcgagattgctcgaggcctcgttgactccaagcagtccttcctgtgggttgtccgacccggctttgtcaagggctccacctgggttgagcccctgcccgatggtttcctcggtgagcgaggccgaattgtcaagtgggtcccccagcaggaagttctggcccacggtgccattggtgccttctggacccactccggctggaactccactctcgagtccgtctgcgagggtgtccccatgatcttctccgactttggcctcgaccagcccctcaacgcccgatacatgtccgatgttctcaaggtcggtgtctacctcgagaacggctgggagcgaggtgagattgccaacgccatccgacgagtcatggtcgacgaggaaggtgagtacatccgacagaacgcccgagtcctcaagcagaaggccgatgtctctctcatgaagggtggttcttcttacgagtctctcgagtctctcgtttcctacatctcttctttgtaagctatttacagcatgtgtaatgaggaatataacgttgattgaattgtttgtgaaaaatgt

SEQ ID NO: 192 - DNA, 1542 bp, Artificial sequence
  UGT9
cgtccatatatatctatgctgcgtcgtccttttcgtgacatcaccaaaacacatacaaaaatggccacctccgactccattgtcgacgaccgaaagcagctgcacgttgccaccttcccctggctcgcctttggccacattctgccctacctccagctctccaagctcattgctgagaagggccacaaggtttctttcctgtccaccacccgaaacatccagcgactctcctcccacatctctcctctcatcaacgttgtccagctcaccctcccccgagtccaggagctccccgaggatgccgaggccaccactgatgtccaccccgaggacatcccctacctcaagaaggcctccgacggtctgcagcccgaggtcacccgattcctcgagcagcactctcccgactggatcatctacgactacacccactactggctcccctccattgctgcttctctcggtatctctcgagcccacttctccgtcaccaccccctgggccattgcttacatgggcccctctgctgacgccatgatcaacggttccgacggccgaaccaccgtcgaggatctcaccacccctcccaagtggttccccttccccaccaaggtctgctggcgaaagcacgatctcgcccgactcgtcccctacaaggcccccggtatctccgacggttaccgaatgggtctggttctcaagggctccgactgtctgctctccaagtgctaccacgagtttggtacccagtggctccccctgctcgagactctgcaccaggtccccgttgtccccgtcggtctgctccctcccgagatccccggtgacgagaaggacgagacttgggtttccatcaagaagtggctcgacggcaagcagaagggctccgtcgtctacgttgctctcggctccgaggttcttgtctcccagactgaggtcgtcgagctcgccctcggtctggagctctccggtctgcccttcgtctgggcctaccgaaagcccaagggtcccgccaagtccgactccgtcgagctccccgacggtttcgtcgagcgaactcgagatcgaggtctggtctggacctcttgggctccccagctccgaatcctctcccacgagtccgtctgcggtttcctgacccactgtggttccggctccattgtcgagggcctcatgttcggccaccccctcatcatgctgcccatcttcggtgaccagcccctcaacgcccgactcctcgaggacaagcaggtcggtatcgagatcccccgaaacgaagaggacggctgcctcaccaaggagtctgttgcccgatctctgcgatctgttgttgtcgagaaagagggtgagatctacaaggccaacgcccgagagctctccaagatctacaacgacaccaaggtcgagaaggagtacgtttcccagtttgtcgactacctcgagaagaacgcccgagctgtcgccattgaccacgagagttaaaattaacagatagtttgccggtgataattctcttaacctcccacactcctttgacataac

SEQ ID NO: 193 - DNA, 880 bp, Artificial sequence
  pTPI
aaacaaaagagctgaaatcatatccttcagtagtagtatagtcctgttatcacagcatcaattacccccgtccaagtaagttgattgggatttttgtttacagatacagtaatatacttgactatttctttacaggtgactcagaaagtgcatgttggaaatgagccacagaccaagacaagatatgacaaaattgcactattcgatgcagaattcgacggtgtttccattggtgttatgacattcatctgcattcatacaaaaaagtcttggtagtggtacttttgcgttattacctccgatatctacgcaccccccaacccccctgctacagtaaagagtgtgagtctactgtacatgcttactaaaccacctactgtacagcgaaacccctcagcaaaatcacacaatcagctcattacaacacacccaatgacctcaccacaaattctatacgccttttgacgccattattacagtagcttgcaacgccgttgtcttaggttccatttttagtgctctattacctcacttaacccgtataggcagatcaggccatggcactaagtgtagagctagaggttgatatcgccacgagtgctccatcagggctagggtggggttagaaatacagtccgtgcgcactcaaaaggcgtccgggttagggcatccgataatatcgcctggactcggcgccatattctcgacttctgggcgcgttgtattcatctcctccgcttcccaacacttccacccgtttctccatcccaaccaatagaatagggtaaccttattcgggacactttcgtcatacatagtcagatatacaagcaatgtcactctccttcgtactcgtacatacaacacaactacattcaaa

SEQ ID NO: 194 - DNA, 1183 bp, Artificial sequence
  gpdT-pGPD
ctatccgaagatcaagagcgaagcaagttgtaagtccaggacatgtttcccgcccacgcgagtgatttataacacctctcttttttgacacccgctcgccttgaaattcatgtcacataaattatagtcaacgacgtttgaataacttgtcttgtagttcgatgatgatcatatgattacattaatagtaattactgtatggcgcgccggtagtcggaaagagccgggaccggccggcgagcataaaccggacgcagtaggatgtcctgcacgggtctttttgtggggtgtggagaaaggggtgcttggagatggaagccggtagaaccgggctgcttggggggatttggggccgctgggctccaaagaggggtaggcatttcgttggggttacgtaattgcggcatttgggtcctgcgcgcatgtcccattggtcagaattagtccggataggagacttatcagccaatcacagcgccggatccacctgtaggttgggttgggtgggagcacccctccacagagtagagtcaaacagcagcagcaacatgatagttgggggtgtgcgtgttaaaggaaaaaaaaagaagcttgggttatattcccgctctatttagaggttgcgggatagacgccgacggagggcaatggcgccatggaaccttgcggatatcgatacgccgcggcggactgcgtccgaaccagctccagcagcgttttttccgggccattgagccgactgcgaccccgccaacgtgtcttggcccacgcactcatgtcatgttggtgttgggaggccactttttaagtagcacaaggcacctagctcgcagcaaggtgtccgaaccaaagaagcggctgcagtggtgcaaacggggcggaaacggcgggaaaaagccacgggggcacgaattgaggcacgccctcgaatttgagacgagtcacggccccattcgcccgcgcaatggctcgccaacgcccggtcttttgcaccacatcaggttaccccaagccaaacctttgtgttaaaaagcttaacatattataccgaacgtaggtttgggcgggcttgctccgtctgtccaaggcaacatttatataagggtctgcatcgccggctcaattgaatcttttttcttcttctcttctctatattcattcttgaattaaacacacatcaaca

SEQ ID NO: 195 - DNA, 639 bp, Artificial sequence
  pgmT-pTEF
acttcgagctaatccagtagcttacgttacccaggggcaggtcaactggctagccacgagtctgtcccaggtcgcaatttagtgtaataaacaatatatatattgagtctaaagggaattgtagctattgtgattgtgtgattttcgtcttgctggttcttattgtgtcccattcgtttcatcctgatgaggacccctggcgtacgccggcgaagcttggtaccagagacgggttggcggcgtatttgtgtcccaaaaaacagccccaattgccccaattgaccccaaattgacccagtagcgggcccaaccccggcgagagcccccttcaccccacatatcaaacctcccccggttcccacacttgccgttaagggcgtagggtactgcagtctggaatctacgcttgttcagactttgtactagtttctttgtctggccatccgggtaacccatgccggacgcaaaatagactactgaaaatttttttgctttgtggttgggactttagccaagggtataaaagaccaccgtccccgaattacctttcctcttcttttctctctctccttgtcaactcacacccgaaatcgttaagcatttccttctgagtataagaatcattcgctagccacaaaa

SEQ ID NO: 196 - DNA, 1009 bp, Artificial sequence
  pgkT-pPGM
gctatttacagcatgtgtaatgaggaatataacgttgattgaattgtttgtgaaaaatgtagaaaatttcagtgaagttgtgttttctatatagtaagcacttttggtacaagtatctgcacatccctgcatgttacaagcctgatcatgcagggcaatattctgactataaatatacctcgatattttagcaagctatacgtacgtaccaaccacagattacgacccattcgcagtcacagttcactagggtttgggttgcatccgttgagagtggtttgtttttaaccttctccatgtgctcactcaggttttgggttcagatcaaatcaaggcgtgaaccactgtttgaggacaaatgtgacacaaccaaccagtgtcaggggcaagtccgtgacaaaggggaagatacaatgcaattactgacagttacggactgcctcgatgccctaaccttgccccaaaataagacaactgtcctcgtttaagcgcaaccctattcagcgtcacgtcataatagcgtttggatagcactagtctatgaggagcgttttatgttgcggtgagggcgattggtgctcatatgggttcaattgaggtggtggaacgagcttagtcttcaattgaggtgcgagcgacacaattgggtgtcacgtggcctaattgacctcggatcgtggagtccccagttatacagcaaccacgaggtgcatgagtaggagacgtcaccagacaatagggtttttttggactggagagggtagggcaaaagcgctcaacgggctgtttggggagctatgggggaggaattggcgatatttgtgaggttgacggctccgatttgcgtgttttgtcgcttctgcatctccccatacccatatcttccctccccacctctttccacgataattttacggatcagcaataaggttccttctcctagtttccacgtccatatatatctatgctgcgtcgtccttttcgtgacatcaccaaaacacatacaaaa

SEQ ID NO: 197 - DNA, 2472 bp, Artificial sequence
  LEU2 and flanking sequences
aaaattaacagatagtttgccggtgataattctcttaacctcccacactcctttgacataacgatttatgtaacgaaactgaaatttgaccagatattgttgtaaatagaaaatctggcttgtaggtggaaactagtaacggccgccagtgtgctggaattcggctccactgtcctccactacaaacacacccaatctgcttcttctagtcaaggttgctacaccggtaaattataaatcatcatttcattagcagggctgggccctttttatagagtcttatacactagcggaccctgccggtagaccaacccgcaggcgcgtcagtttgctccttccatcaatgcgtcgtagaaacgacttactccttcttgagcagctccttgaccttgttggcaacaaagtctccgacctcggaggtggaggaagagcctccgatatcggcggtagtgataccagcctcgacggactccttgacggcagcctcaacagcgtcaccggcgggcttcatgttaagagagaacttgagcatcatggcggcagacagaatggtggcaatggggttgaccttctgcttgccgagatcgggggcagatccgtgacagggctcgtacagaccgaacgcctcgttggtgtcgggcagagaagccagagaggcggagggcagcagacccagagaaccggggatgacggaggcctcgtcggagatgatatcgccaaacatgttggtggtgatgatgataccattcatcttggagggctgcttgatgaggatcatggcggccgagtcgatcagctggtggttgagctcgagctgggggaattcgtccttgaggactcgagtgacagtctttcgccaaagtcgagaggaggccagcacgttggccttgtcaagagaccacacgggaagaggggggttgtgctgaagggccaggaaggcggccattcgggcaattcgctcaacctcaggaacggagtaggtctcggtgtcggaagcgacgccagatccgtcatcctcctttcgctctccaaagtagatacctccgacgagctctcggacaatgatgaagtcggtgccctcaacgtttcggatgggggagagatcggcgagcttgggcgacagcagctggcagggtcgcaggttggcgtacaggttcaggtcctttcgcagcttgaggagaccctgctcgggtcgcacgtcggttcgtccgtcgggagtggtccatacggtgttggcagcgcctccgacagcaccgagcataatagagtcagcctttcggcagatgtcgagagtagcgtcggtgatgggctcgccctccttctcaatggcagctcctccaatgagtcggtcctcaaacacaaactcggtgccggaggcctcagcaacagacttgagcaccttgacggcctcggcaatcacctcggggccacagaagtcgccgccgagaagaacaatcttcttggagtcagtcttggtcttcttagtttcgggttccattgtggatgtgtgtggttgtatgtgtgatgtggtgtgtggagtgaaaatctgtggctggcaaacgctcttgtatatatacgcacttttgcccgtgctatgtggaagactaaacctccgaagattgtgactcaggtagtgcggtatcggctagggacccaaaccttgtcgatgccgatagcgctatcgaacgtaccccagccggccgggagtatgtcggaggggacatacgagatcgtcaagggtttgtggccaactggtaaataaatgatgactcaggcgacgacggaattcgacagcaactactcctttcaccaaccatgtgcattttagctcgaataacattcacaggcttggtgatctacatccatggtgtctggccgattaccgtggtgttttggcagtaacgagaatattgagtggactcttcccatcaccaataaagactcatactacaatcacgagcgcttcagctgccactatagtgttggtgacacaatacccctcgatgctgggcattactgtagcaagagatattatttcatggcgcatttttccagtctacctgactttttagtgtgatttcttctccacattttatgctcagtgtgaaaagttggagtgcacacttaattatcgccggttttcggaaagtactatgtgctcaaggttgcaccccacgttacgtatgcagcacattgagcagcctttggaccgtggagataacggtgtggagatagcaacgggtagtcttcgtaataagcaatgcagccgaattctgcagatatccatcacactggcggccgctcgagcatgcatctagatggcctccttggccgggtttcaattcaattcatcattttttttttattcttttttttgatttcggtttctttgaaatttttttgattcggtaatctccgaacagaaggaagaacgaaggaaggagcacagacttagattggtatatatacgca

SEQ ID NO: 198 - DNA, 6989 bp, Artificial sequence
  Vector sequences
ctagatggcctccttggccgggtttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagacagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaagagcgacaaagattttgttatcggctttattgctcaaagagacatgggtggaagagatgaaggttacgattggttgattatgacacccggtgtgggtttagatgacaagggagacgcattgggtcaacagtatagaaccgtggatgatgtggtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattacccgggaatctcggtcgtaatgatttttataatgacgaaaaaaaaaaaattggaaagaaaaccccccccccgcagcgttgggtcctggccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaattcccccttacacggaggcatcaagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcaggtgggccattctcatgaagaatatcttgaatttattgtcatattactagttggtgtggaagtccatatatcggtgatcaatatagtggttgacatgctggctagtcaacattgagccttttgatcatgcaaatatattacggtattttacaatcaaatatcaaacttaactattgactttataacttatttaggtggtaacattcttataaaaaagaaaaaaattactgcaaaacagtactagcttttaacttgtatcctaggttatctatgctgtctcaccatagagaatattacctatttcagaatgtatgtccatgattcgccgggtaaatacatataatacacaaatctggcttaataaagtctataatatatctcataaagaagtgctaaattggctagtgctatatatttttaagaaaatttcttttgactaagtccatatcgactttgtaaaagttcactttagcatacatatattacacgagccagaaattgtaacttttgcctaaaatcacaaattgcaaaatttaattgcttgcaaaaggtcacatgcttataatcaacttttttaaaaatttaaaatacttttttattttttatttttaaacataaatgaaataatttatttattgtttatgattaccgaaacataaaacctgctcaagaaaaagaaactgttttgtccttggaaaaaaagcactacctaggagcggccaaaatgccgaggctttcatagcttaaactctttacagaaaataggcattatagatcagttcgagttttcttattcttccttccggttttatcgtcacagttttacagtaaataagtatcacctcttagagttaactatgagataagcaagtatcatctcatttcatttacctgaagtcgagtaaacagaaaatccaattgttgatgaacctcaatgacttagaactatctatcggcagatcatataaagaggatttaggtacctagaggactgtacctggagtatatatatatatatatatatattatctcaactatagtccatagaggtttctttcttgaggccttaaactgctaaagaatgatattggtggaatgcaagcaccaatctctcttctttcgtaactgttcatatacttcaaaccaagaatgtaacgggcattgacccatccaaaaccttcagtagctgcccctttaaagtcagcaccttgattaccgtattctgcttcaacacgatgaggatctgttcctcttgtgacatcatatttttcaaccacaataccattataatcgacaaaagcctttgtcatcatgaaaagccatctataagctagcctattcgttacagttaaataaccataagaacggaggccttcccaagcaagaatttgatggggtgcccaaccaaatggatagtcccattgtctaattggtctcgaaatagaaattgggcctcgagaacgctccgtacatgcagctaaacctccaagcatctctaacttgggtagtgctttctccaccattttctgtgcttgctccttcgtggcaagtccagcccataatgcccagaatgtagttgcggattcgtatgacgttctgtgcttgatttttgtgttgtagtcaaagaaaaaccccgactcgtcatcccacatatatttggtaattgatgaggcaacgctaattatcaacatatagattgttatctatctgcatgaacacgaaatctttacttgacgacttgaggctgatggtgtttatgcaaagaaaccactgtgtttaatatgtgtcactgtttgatattactgtcagcgtagaagataatagtaaaagcggttaataagtgtatttgagataagtgtgataaagtttttacagcgaaaagacgataaatacaagaaaatgattacgaggatacggagagaggtatgtacatgtgtatttatatactaagctgccggcggttgtttgcaagaccgagaaaaggctagcaagaatcgggtcattgtagcgtatgcgcctgtgaacattctcttcaacaagtttgattccattgcggtgaaatggtaaaagtcaaccccctgcgatgtatattttcctgtacaatcaatcaaaaagccaaatgatttagcattatctttacatcttgttattttacagattttatgtttagatcttttatgcttgcttttcaaaaggcctgcaggcaagtgcacaaacaatacttaaataaatactactcagtaataacctatttcttagcatttttgacgaaatttgctattttgttagagtcttttacaccatttgtctccacacctccgcttacatcaacaccaataacgccatttaatctaagcgcatcaccaacattttctggcgtcagtccaccagctaacataaaatgtaagctctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctgcaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaacacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggtttccgcgcacatttccccgaaaagtgccacctgacgtctaagaaaccattattatcatgacattaacctataaaaataggcgtatcacgaggccctttcgtcttggccacctaggccggccttcccggaagtatatactaattcattccttgaatatttatgaaaagcaacatgtgtatttcttgtgtgtgcggcaaacgtagcaattgcaactgcataaacgatgattgtaaaagtatcacactttgctcagacaggttagattcacctggtacgagggcagtgtcttaaaggttccatctacctcggcccttgtttcttgaagagtggtcaatatgtgttttatacagctgaaatttcccctgtatgttgagatcgtgtatattggtcataatctgggctctttagtcgatcccagttttctcgggcaagtttttttctccacaaagtaccgctggaaaactctatgtgacttgttgacagattacttgggttatctgcgggatatgtcttggataggcaaccgggcatatatcaccgggcggactgttggttctgtac

SEQ ID NO: 199 - DNA, 1170 bp, Artificial sequence
  pENO
tcgggcaagtttttttctccacaaagtaccgctggaaaactctatgtgacttgttgacagattacttgggttatctgcgggatatgtcttggataggcaaccgggcatatatcaccgggcggactgttggttctgtacgtacatacagcactttgagctcatgtctcacacgcaaccatggtgcgtggaggctttggcatcctttctacttgtagtggctatagtacttgcagtccaagcaaacatgagtatgtgcttgtatgtactgaaacccgtctacggtaatattttagagtgtggaactatgggatgagtgctcattcgatactatgttgtcacccgatttgccgtttgcgaggtaagacacattcggtggttcaggcggctacttgtatgtagcatccacgttcatgttttgtggatcagattaatggtatggatatgcacggggcgtttccccggtaacgtgtaggcagtccagtgcaacccagacagctgagctctctatagccgtgcgtgtgcggtcatatcacgctacacttagctacagaataaagctcggtagcgccaacagcgttgacaaatagctcaagggcgtggagcacagggtttaggaggttttaatgggcgagaaggcgcgtagatgtagtcttcctcggtcccatcggtaatcacgtgtgtgccgatttgcaagacgaaaagccacgagaataaaccgggagaggggatggaagtccccgaacagcaaccagcccttgccctcgtggacataacctttcacttgccagaactctaagcgtcaccacggtatacaagcgcacgtagaagattgtggaagtcgtgttggagactgttgatttgggcggtggaggggggtatttgagagcaagtttgagatttgtgccattgagggggaggttattgtggccatgcagtcggatttgccgtcacgggaccgcaacatgcttttcattgcagtccttcaactatccatctcacctcccccaatggcttttaactttcgaatgacgaaagcacccccctttgtacagatgactatttgggaccaatccaatagcgcaattgggtttgcatcatgtataaaaggagcaatcccccactagttataaagtcacaagtatctcagtatacccgtctaaccacacattt

SEQ ID NO: 200 - DNA, 2276 bp, Artificial sequence
  HPH
aaattaacagatagtttgccggtgataattctcttaacctcccacactcctttgacataacgatttatgtaacgaaactgaaatttgaccagatattgttgtaaatagaaaatctggcttgtaggtggcaaactagtaacggccgccagtgtgctggaattgaatatttaccgttcgtataatgtatgctatacgaagttataccggtctcgtagtgttcacgttcagttcacggtgagcttaaaactatcttcaagaagagatttgagacctgatttatacttgcagcaatgtttacttcttatcgcgatacacgaatgtgatacggatcaaagtaagcaggactacgataagataacgaatgcggtgcagtccatgtcgattaggtatagatacatttattttgtgttatgttacattttggggggatactgtcctacttgtagtacctacttgtagtggcgcgtctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcaggtcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggagacgctgtcgaacttttcgatcagaaacttctcgacagacgtcgcggtgagttcaggctttttcatatgggtacctgagaacatttttgtgtctaggtgtttgtgtttggactgcgatcagtgaagaaaagaagaggaaaaattgtgcaagaaattttgctttcaagacttggctgatgcagcagggtaactctgggacacagacctatgtttgtggttaaactcaatgcacgtggtacgtgcgtggagcgcttacccatccaagggtgtggacatggaaccgacggtccgtggagttgtgtaatgtcattttggcgactcttgaagcaaggctataaaaaaattgtgtggcttgagtcttatcgagctcggtcactacaagagttaatcttcctgtctcaggcagacaggtcaggcagggttacttttgggtgtgctgtaactcactgtatggccgttagtgcgcatagacgttgtacatactggaccgaattgtagcgtgctcaatagggccaataaagctattgtagggatccataacttcgtataatgtatgctatacgaacggtacccgggcaattctgcagatatccatcacactggcggccgctcgagcatgcatctagatggcctccttggccgggtttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaacctgca

SEQ ID NO: 201 - DNA, 600 bp, Artificial sequence
  Sc Eno2.promoter
gtgtcgacgctgcgggtatagaaagggttctttactctatagtacctcctcgctcagcatctgcttcttcccaaagatgaacgcggcgttatgtcactaacgacgtgcaccaacttgcggaaagtggaatcccgttccaaaactggcatccactaattgatacatctacacaccgcacgccttttttctgaagcccactttcgtggactttgccatatgcaaaattcatgaagtgtgataccaagtcagcatacacctcactagggtagtttctttggttgtattgatcatttggttcatcgtggttcattaattttttttctccattgctttctggctttgatcttactatcatttggatttttgtcgaaggttgtagaattgtatgtgacaagtggcaccaagcatatataaaaaaaaaaagcattatcttcctaccagagttgattgttaaaaacgtatttatagcaaacgcaattgtaattaattcttattttgtatcttttcttcccttgtctcaatcttttatttttattttatttttcttttcttagtttctttcataacaccaagcaactaatactataacatacaataata

SEQ ID NO: 202 - DNA, 600 bp, Artificial sequence
  Sc Fba1.promoter
ctacttggcttcacatacgttgcatacgtcgatatagataataatgataatgacagcaggattatcgtaatacgtaatagttgaaaatctcaaaaatgtgtgggtcattacgtaaataatgataggaatgggattcttctatttttcctttttccattctagcagccgtcgggaaaacgtggcatcctctctttcgggctcaattggagtcacgctgccgtgagcatcctctctttccatatctaacaactgagcacgtaaccaatggaaaagcatgagcttagcgttgctccaaaaaagtattggatggttaataccatttgtctgttctcttctgactttgactcctcaaaaaaaaaaaatctacaatcaacagatcgcttcaattacgccctcacaaaaacttttttccttcttcttcgcccacgttaaattttatccctcatgttgtctaacggatttctgcacttgatttattataaaaagacaaagacataatacttctctatcaatttcagttattgttcttccttgcgttattcttctgttcttctttttcttttgtcatatataaccataaccaagtaatacatattcaaa

SEQ ID NO: 203 - DNA, 600 bp, Artificial sequence
  Sc Tef1.promoter
ttggctgataatagcgtataaacaatgcatactttgtacgttcaaaatacaatgcagtagatatatttatgcatattacatataatacatatcacataggaagcaacaggcgcgttggacttttaattttcgaggaccgcgaatccttacatcacacccaatcccccacaagtgatcccccacacaccatagcttcaaaatgtttctactccttttttactcttccagattttctcggactccgcgcatcgccgtaccacttcaaaacacccaagcacagcatactaaatttcccctctttcttcctctagggtgtcgttaattacccgtactaaaggtttggaaaagaaaaaagacaccgcctcgtttctttttcttcgtcgaaaaaggcaataaaaatttttatcacgtttctttttcttgaaaatttttttttttgatttttttctctttcgatgacctcccattgatatttaagttaataaacggtcttcaatttctcaagtttcagtttcatttttcttgttctattacaactttttttacttcttgctcattagaaagaaagcatagcaatctaatctaagttttaattacaaa

SEQ ID NO: 204 - DNA, 600 bp, Artificial Sequence
  Sc Pgk1.promoter
gggccagaaaaaggaagtgtttccctccttcttgaattgatgttaccctcataaagcacgtggcctcttatcgagaaagaaattaccgtcgctcgtgatttgtttgcaaaaagaacaaaactgaaaaaacccagacacgctcgacttcctgtcttcctattgattgcagcttccaatttcgtcacacaacaaggtcctagcgacggctcacaggttttgtaacaagcaatcgaaggttctggaatggcgggaaagggtttagtaccacatgctatgatgcccactgtgatctccagagcaaagttcgttcgatcgtactgttactctctctctttcaaacagaattgtccgaatcgtgtgacaacaacagcctgttctcacacactcttttcttctaaccaagggggtggtttagtttagtagaacctcgtgaaacttacatttacatatatataaacttgcataaattggtcaatgcaagaaatacatatttggtcttttctaattcgtagtttttcaagttcttagatgctttctttttctcttttttacagatcatcaaggaagtaattatctactttttacaacaaatataaaaca

SEQ ID NO: 205 - DNA, 1001 bp, Artificial sequence
  Kl prom 12.pro
cgtaaaaactaaaacgagcccccaccaaagaacaaaaaagaaggtgctgggcccccactttcttcccttgcacgtgataggaagatggctacagaaacaagaagatggaaatcgaaggaaagagggagactggaagctgtaaaaactgaaatgaaaaaaaaaaaaaaaaaaaaaaaacaagaagctgaaaatggaagactgaaatttgaaaaatggtaaaaaaaaaaaagaaacacgaagctaaaaacctggattccattttgagaagaagcaagaaaggtaagtatggtaacgaccgtacaggcaagcgcgaaggcaaatggaaaagctggagtccggaagataatcatttcatcttcttttgttagaacagaacagtggatgtccctcatctcggtaacgtattgtccatgccctagaactctctgtccctaaaaagaggacaaaaacccaatggtttccccagcttccagtggagccaccgatcccactggaaaccactggacaggaagagaaaatcacggacttcctctattgaaggataattcaacactttcaccagatcccaaatgtcccgcccctattcccgtgttccatcacgtaccataacttaccatttcatcacgttctctatggcacactggtactgcttcgactgctttgcttcatcttctctatgggccaatgagctaatgagcacaatgtgctgcgaaataaagggatatctaatttatattattacattataatatgtactagtgtggttattggtaattgtacttaattttgatatataaagggtggatctttttcattttgaatcagaattggaattgcaacttgtctcttgtcactattacttaatagtaattatatttcttattaaccttttttttaagtcaaaacaccaaggacaagaactactcttcaaaggtatttcaagttatcatacgtgtcacacacgcttcacagtttcaagtaaaaaaaaagaatattacaca

SEQ ID NO: 206 - DNA, 403 bp, Artificial sequence
  Ag lox_TEF1.promoter
taccgttcgtataatgtatgctatacgaagttatgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagacctgcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaaca

SEQ ID NO: 207 - DNA, 1000 bp, Artificial sequence
  Kl prom 6.pro
caaagggggggcagggacagggatacgacaagggctggggaaaaaaaaaaagatagatacgattggccgggtaagcctggggaaatgtagcaagtgcgggtaagttaaaaggtaaccacgtgactccggaagagtcacgtggttacggacttttttctctagatctcagctttttatcggtcttaccctgccctcctgccccctgccccttccctttgccccaaaaagaaaggaaatctgttggatttcgctcaggccatccctttcgttaatatcggttatcgctttacacactgcacatccttctgtccaaaaggaatccagaagtttagcttttccttcctttcccacagacattagcctaggccctctctcatcatttgcatgcctcagccaatgtaccaagaataacgcaacgaggttgggaaattttaacccaacaatcgatgcagatgtgacaagagattagacacgttccagataccagattacacagcttgtgctagcagagtgacatatggtggtgttgtgtctcgtttagtacctgtaatcgagagtgttcaaatcagtcgatttgaacacccttactgccactgaatattgattgaataccgtttattgaaggttttatgagtgatcttctttcggtccaggacaatttgttgagctttttctatgtagagttccgtcccttttttttttttttttgctttctcgcacttactagcactatttttttttcacacactaaaacactttattttaatctatatatatatatatatatatatgtaggaatggaatcacagacatttgatactcatcctcatccttattaattcttgttttaatttgtttgacttagccaaaccaccaatctcaacccatcgtatttcaggtattgtgtgtctagtgtgtctctggtatacggaaataagtgccagaagtaaggaagaaacaaagaacaagtgtctgaatactactagcctctcttttcata

SEQ ID NO: 208 - DNA, 600 bp, Artificial sequence
  Sc Pma1.pro
ccatcatgaaaaatctctcgacaccgtttatccattgcttttttgttgtctttttccctcgttcacagaaagtctgaagaagctatagtagaactatgagctttttttgtttctgttttccttttttttttttttacctctgtggaaattgttactctcacactctttagttcgtttgtttgttttgtttattccaattatgaccggtgacgaaacgtggtcgatggtgggtaccgcttatgctcccctccattagtttcgattatataaaaaggccaaatattgtattattttcaaatgtcctatcattatcgtctaacatctaatttctcttaaattttttctctttctttcctataacaccaatagtgaaaatctttttttcttctatatctacaaaaactttttttttctatcaacctcgttgataaattttttctttaacaatcgttaataattaattaattggaaaataaccattttttctctcttttatacacacattcaaaagaaagaaaaaaaatataccccagctagttaaagaaaatcattgaaaagaataagaagataagaaagatttaattatcaaacaatatcaaa

SEQ ID NO: 209 - DNA, 600 bp, Artificial sequence
  Sc Vps68.promoter
gatatagccgctacgactgattagtgatgtgataaagatagaagatttaagtcacagaggcgtgcatctacgattttggcgtttcacattttttacacttaaattttagtgatctagccgtgaccttggcagcagtttccaaaatcattccatgaccatgtcatgcttaagaacgttagacccagaacaagtggacctgtattctaactcttcactcttgggcaaagataatagtattatcttttaccccattttttgtatgttttttcgtttattgagtttggcgtttcctatttagaaatagtacaatccggtcaatcattcgatagtgaaatatatatatttaactaggaaaattagtaaaacctcatttaaagatcattcaccttgatatatactactattgaccttttgttaatgaccattttcgtaaaaatgaactgcgattctcttctggaatttgttaccctaccttattcactaaatcagaaataataatgtgcagcgcccctttcataaagaaggcaagtatagggcatatagttaaaggtcagaactctttatccccaactacaagatcaattagaaaatcacatcata

SEQ ID NO: 210 - DNA, 600 bp, Artificial sequence
  Sc Oye2.promoter
actacaatttagcggcttagcacaatacgcgttttcaacttcctacgctagcgatgacaaaatgtctccaagaggcggaacttgcgacggatgcatggaaatatcttacgtaatgaacttccgtaatgaacttccgtaattcaagatctcttagcatctcttgttcaatcttcagactctactaagtgttcttaccaaccattggatgctcattacaaatgaatgaatatattgcacggaacggaagcggcatgctttttccgtgtcgtgtgcttagtaaagcaaaacggagtagaatcggtaagaacttcctttttgggttggaaaatcattgccattgtttggacacctttctttttccgtattgttcgagcaccgcgtttctttttgggtacttgatgaggtagcagattcctggaacgtgctttctctcgaggtaacctgccttgttcctcctggtgactttctaaaatataaaaggaaaagcatatctctagtttcgagttttttcttcatactttatttccttatgttaaacggtccagatatagaataaatcatcatattaagctaaatatagacgataatatagtatcgata

SEQ ID NO: 211 - DNA, 810 bp, Artificial sequence
  KANMX
atgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtttggctcaggcgcaatcacgaatgaataacggtttggttgatgcgagtgattttgatgacgagcgtaatggctggcctgttgaacaagtctggaaagaaatgcataagcttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaa

SEQ ID NO: 212 - DNA, 301 bp, Artificial sequence
  Adh1.Terminator
agcgaatttcttatgatttatgatttttattattaaataagttataaaaaaaataagtgtatacaaattttaaagtgactcttaggttttaaaacgaaaattcttattcttgagtaactctttcctgtaggtcaggttgctttctcaggtatagcatgaggtcgctcttattgaccacacctctaccggcatgccgagcaaatgcctgcaaatcgctccccatttcacccaattgtagatatgctaactccagcaatgagttgatgaatctcggtgtgtattttatgtcctcagaggacaa

SEQ ID NO: 213 - DNA, 301 bp, Artificial sequence
  Adh2.terminator
agcggatctcttatgtctttacgatttatagttttcattatcaagtatgcctatattagtatatagcatctttagatgacagtgttcgaagtttcacgaataaaagataatattctactttttgctcccaccgcgtttgctagcacgagtgaacaccatccctcgcctgtgagttgtacccattcctctaaactgtagacatggtagcttcagcagtgttcgttatgtacggcatcctccaacaaacagtcggttatagtttgtcctgctcctctgaatcgtgtccctcgatatttctcat

SEQ ID NO: 214 - DNA, 301 bp, Artificial sequence
  Gmp1.Terminator
agtctgaagaatgaatgatttgatgatttctttttccctccatttttcttactgaatatatcaatgatatagacttgtatagtttattatttcaaattaagtagctatatatagtcaagataacgtttgtttgacacgattacattattcgtcgacatcttttttcagcctgtcgtggtagcaatttgaggagtattattaattgaataggttcattttgcgctcgcataaacagttttcgtcagggacagtatgttggaatgagtggtaattaatggtgacatgacatgttatagcaata

SEQ ID NO: 215 - DNA, 301 bp, Artificial sequence
  Sc Tal1.Terminator
aggaagtatctcggaaatattaatttaggccatgtccttatgcacgtttcttttgatacttacgggtacatgtacacaagtatatctatatatataaattaatgaaaatcccctatttatatatatgactttaacgagacagaacagttttttattttttatcctatttgatgaatgatacagtttcttattcacgtgttatacccacaccaaatccaatagcaataccggccatcacaatcactgtttcggcagcccctaagatcagacaaaacatccggaaccaccttaaatcaacgtc

SEQ ID NO: 216 - DNA, 301 bp, Artificial sequence
  Sc Tpi1.terminator
agattaatataattatataaaaatattatcttcttttctttatatctagtgttatgtaaaataaattgatgactacggaaagcttttttatattgtttctttttcattctgagccacttaaatttcgtgaatgttcttgtaagggacggtagatttacaagtgatacaacaaaaagcaaggcgctttttctaataaaaagaagaaaagcatttaacaattgaacacctctatatcaacgaagaatattactttgtctctaaatccttgtaaaatgtgtacgatctctatatgggttactca

SEQ ID NO: 217 - DNA, 285 bp, Artificial sequence
  Ag Tef1_lox.terminator
atcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaaacgagctcataacttcgtataatgtatgctatacgaacggta

SEQ ID NO: 218 - DNA, 301 bp, Artificial sequence
  Sc Pdc1.terminator
agcgatttaatctctaattattagttaaagttttataagcatttttatgtaacgaaaaataaattggttcatattattactgcactgtcacttaccatggaaagaccagacaagaagttgccgacagtctgttgaattggcctggttaggcttaagtctgggtccgcttctttacaaatttggagaatttctcttaaacgatatgtatattcttttcgttggaaaagatgtcttccaaaaaaaaaaccgatgaattagtggaaccaaggaaaaaaaaagaggtatccttgattaaggaaca

SEQ ID NO: 219 - DNA, 301 bp, Artificial sequence
  Sc Tdh1.terminator
aataaagcaatcttgatgaggataatgatttttttttgaatatacataaatactaccgtttttctgctagattttgtgaagacgtaaataagtacatattactttttaagccaagacaagattaagcattaactttacccttttctcttctaagtttcaatactagttatcactgtttaaaagttatggcgagaacgtcggcggttaaaatatattaccctgaacgtggtgaattgaagttctaggatggtttaaagatttttcctttttgggaaataagtaaacaatatattgctgcctt

SEQ ID NO: 220 - DNA, 301 bp, Artificial sequence
  Sc Eno1.terminator
aagcttttgattaagccttctagtccaaaaaacacgtttttttgtcatttatttcattttcttagaatagtttagtttattcattttatagtcacgaatgttttatgattctatatagggttgcaaacaagcatttttcattttatgttaaaacaatttcaggtttaccttttattctgcttgtggtgacgcgtgtatccgcccgctcttttggtcacccatgtatttaattgcataaataattcttaaaagtggagctagtctatttctatttacatacctctcatttctcatttcctcc

SEQ ID NO: 221 - DNA, 1000 bp, Artificial Sequence
  Kl prom 3.pro
gagcctgtccaagcaaatgccttctcataaatggtgccaaagacccgcaagcccaaagcaattaccccccaaaaagaaatgatatagtgcaagatacgtatatgaccatgacttgactaggtgaaacagtgcagaaacagccgcacaaaagcagccctaaccctcagagtcgattttactctttcaggtaataaagcctcgacatcaattttagacagaagccaggctggcctcgagattatagccataggcaagcaagaggagagaaggggaggccccccatggggggcctcccccccgctgtcaaggtttggcagaacctagcttcattaggccactagcccagcctaaaacgtcaacgggcaggaggaacactcccacaagacggcgtagtattctcgattcataaccattttctcaatcgaattacacagaacacaccgtacaaacctctctatcataactacttaatagtcacacacgtactcgtctaaatacacatcatcgtcctacaagttcatcaaagtgttggacagacaactataccagcatggatctcttgtatcggttcttttctcccgctctctcgcaataacaatgaacactgggtcaatcatagcctacacaggtgaacagagtagcgtttatacagggtttatacggtgattcctacggcaaaaatttttcatttctaaaaaaaaaaagaaaaatttttctttccaacgctagaaggaaaagaaaaatctaattaaattgatttggtgattttctgagagttccctttttcatatatcgaattttgaatataaaaggagatcgaaaaaatttttctattcaatctgttttctggttttatttgatagtttttttgtgtattattattatggattagtactggtttatatgggtttttctgtataacttctttttattttagtttgtttaatcttattttgagttacattatagttccctaactgcaagagaagtaacattaaaa

SEQ ID NO: 222 - DNA, 1000 bp, Artificial sequence; identical to SEQ ID NO: 221
  Kl prom 2.pro

SEQ ID NO: 223 - DNA, 600 bp, Artificial sequence
  Sc PRE3.promoter
caaacattaatttgttctgcatactttgaacctttcagaaaataaaaaacattacgcgcatacttaccctgctcgcgaagaagagtaacactaacgcattctatgggcaattgaagacagtattcagtacaagacatagtccgtttccttgagtcaattcctatagcattatgaactagccgcctttaagagtgccaagctgttcaacaccgatcatttttgatgatttggcgtttttgttatattgatagatttcttttgaattttgtcattttcacttttccactcgcaacggaatccggtggcaaaaaagggaaaagcattgaaatgcaatctttaacagtattttaaacaagttgcgacacggtgtacaattacgataagaattgctacttcaaagtacacacagaaagttaacatgaatggaattcaagtggacatcaatcgtttgaaaaagggcgaagtcagtttaggtacctcaatgtatgtatataagaatttttcctcccactttattgtttctaaaagttcaatgaagtaaagtctcaattggccttattactaactaataggtatcttataatcacctaataaaataga

SEQ ID NO: 224 - DNA, 1770 bp, Saccharomyces cerevisiae
  CDS (1)..(1770)
atgagtggagtatcaaataaaacagtatcaattaatggttggtatggcatgccaattcatttactaagggaagaaggcgactttgcccagtttatgattctaaccatcaacgaattaaaaatagccatacatggttacctcagaaataccccatggtacaacatgttgaaggattatttgtttgtgatcttttgttacaagctaataagtaattttttttatctgttgaaagtttatgggccggtgaggttagcagtgagaacatacgagcatagttccagaagattgtttcgttggttattggactcaccatttttgaggggtaccgtagaaaaggaagtcacaaaggtcaaacaatcgatcgaagacgaactaattagatcggactctcagttaatgaatttcccacagttgccatccaatgggatacctcaggatgatgttattgaagagctaaataaattgaacgacttgataccacatacccaatggaaggaaggaaaggtctctggtgccgtttaccacggtggtgatgatttgatccacttacaaacaatcgcatacgaaaaatattgcgttgccaatcaattacatcccgatgtctttcctgccgtacgtaaaatggaatccgaagtggtttctatggttttaagaatgtttaatgccccttctgatacaggttgtggtaccacaacttcaggtggtacagaatccttgcttttagcatgtctgagcgctaaaatgtatgcccttcatcatcgtggaatcaccgaaccagaaataattgctcccgtaactgcacatgctgggtttgacaaagctgcttattactttggcatgaagctacgccacgtggagctagatccaacgacatatcaagtggacctgggaaaagtgaaaaaattcatcaataagaacacaattttactggtcggttccgctccaaactttcctcatggtattgccgatgatattgaaggattgggtaaaatagcacaaaaatataaacttcctttacacgtcgacagttgtctaggttcctttattgtttcatttatggaaaaggctggttacaaaaatctgccattacttgactttagagtcccgggagtcacctcaatatcatgtgacactcataaatatggatttgcaccaaaaggctcgtcagttataatgtatagaaacagcgacttacgaatgcatcagtattacgtaaatcctgcttggactggcgggttatatggctctcctacattagcagggtccaggcctggtgctattgtcgtaggttgttgggccactatggtcaacatgggtgaaaatgggtacattgagtcgtgccaagaaatagtcggtgcagcaatgaagtttaaaaaatacatccaggaaaacattccagacctgaatataatgggcaaccctagatattcagtcatttcattttcttcaaagaccttgaacatacacgaactatctgacaggttgtccaagaaaggctggcatttcaatgccctacaaaagccggttgcactacacatggccttcacgagattgagcgctcatgttgtggatgagatctgcgacattttacgtactaccgtgcaagagttgaagagcgaatcaaattctaaaccatccccagacggaactagcgctctatatggtgtcgccgggagcgttaaaactgctggcgttgcagacaaattgattgtgggattcctagacgcattatacaagttgggtccaggagaggataccgccaccaagtag

SEQ ID NO: 225 - protein, 589 aa, Saccharomyces cerevisiae
MSGVSNKTVSINGWYGMPIHLLREEGDFAQFMILTINELKIAIHGYLRNTPWYNMLKDYLFVIFCYKLISNFFYLLKVYGPVRLAVRTYEHSSRRLFRWLLDSPFLRGTVEKEVTKVKQSIEDELIRSDSQLMNFPQLPSNGIPQDDVIEELNKLNDLIPHTQWKEGKVSGAVYHGGDDLIHLQTIAYEKYCVANQLHPDVFPAVRKMESEVVSMVLRMFNAPSDTGCGTTTSGGTESLLLACLSAKMYALHHRGITEPEIIAPVTAHAGFDKAAYYFGMKLRHVELDPTTYQVDLGKVKKFINKNTILLVGSAPNFPHGIADDIEGLGKIAQKYKLPLHVDSCLGSFIVSFMEKAGYKNLPLLDFRVPGVTSISCDTHKYGFAPKGSSVIMYRNSDLRMHQYYVNPAWTGGLYGSPTLAGSRPGAIVVGCWATMVNMGENGYIESCQEIVGAAMKFKKYIQENIPDLNIMGNPRYSVISFSSKTLNIHELSDRLSKKGWHFNALQKPVALHMAFTRLSAHVVDEICDILRTTVQELKSESNSKPSPDGTSALYGVAGSVKTAGVADKLIVGFLDALYKLGPGEDTATK

SEQ ID NO: 226 - DNA, 825 bp, Saccharomyces cerevisiae
  CDS (1)..(825)
atgatctctgtcatggcggatgagaaacataaggagtattttaagctatactactttcagtacatgataattggtctatgtacgatattattcctctattcggagatatccctggtacctaggggccaaaacatcgaatttagtcttgatgaccccagtatatcaaaacgttatgtacctaacgaactcgtgggcccactagaatgtttgattttgagtgttggactgagtaacatggtcgtcttctggacctgcatgtttgacaaggacttactgaagaagaatagagtaaagagactaagagagaggccggacggaatctcgaacgattttcacttcatgcatactagcattctatgtctgatgctgattataagcataaatgctgccctaacaggcgccttaaagttgattataggaaacttgaggcctgactttgttgatagatgtatacctgacctccaaaagatgagtgattcagattctttggtttttggcttggacatttgcaagcagactaacaaatggattctatacgaaggcttaaaaagcactccaagcggacattcaagtttcatagtcagtaccatgggctttacatatctttggcaaagggttttcaccacacgcaatacaagaagttgcatttggtgccctttattagctctagtagtaatggtttcaagggttatcgatcacagacatcattggtacgatgttgtctctggagctgttctagcatttttagtcatttattgttgctggaaatggacatttacaaacttggcgaaaagagacatacttccttcaccggttagtgtttag

SEQ ID NO: 227 - protein, 274 aa, Saccharomyces cerevisiae
MISVMADEKHKEYFKLYYFQYMIIGLCTILFLYSEISLVPRGQNIEFSLDDPSISKRYVPNELVGPLECLILSVGLSNMVVFWTCMFDKDLLKKNRVKRLRERPDGISNDFHFMHTSILCLMLIISINAALTGALKLIIGNLRPDFVDRCIPDLQKMSDSDSLVFGLDICKQTNKWILYEGLKSTPSGHSSFIVSTMGFTYLWQRVFTTRNTRSCIWCPLLALVVMVSRVIDHRHHWYDVVSGAVLAFLVIYCCWKWTFTNLAKRDILPSPVSV

SEQ ID NO: 228 - DNA, 1347 bp, Saccharomyces cerevisiae
  CDS (1)..(1347)
atgctttcgcttaaaacgttactgtgtacgttgttgactgtgtcatcagtactcgctaccccagtccctgcaagagacccttcttccattcaatttgttcatgaggagaacaagaaaagatactacgattatgaccacggttccctcggagaaccaatccgtggtgtcaacattggtggttggttacttcttgaaccatacattactccatctttgttcgaggctttccgtacaaatgatgacaacgacgaaggaattcctgtcgacgaatatcacttctgtcaatatttaggtaaggatttggctaaaagccgtttacagagccattggtctactttctaccaagaacaagatttcgctaatattgcttcccaaggtttcaaccttgtcagaattcctatcggttactgggctttccaaactttggacgatgatccttatgttagcggcctacaggaatcttacctagaccaagccatcggttgggctagaaacaacagcttgaaagtttgggttgatttgcatggtgccgctggttcgcagaacgggtttgataactctggtttgagagattcatacaagtttttggaagacagcaatttggccgttactacaaatgtcttgaactacatattgaaaaaatactctgcggaggaatacttggacactgttattggtatcgaattgattaatgagccattgggtcctgttctagacatggataaaatgaagaatgactacttggcacctgcttacgaatacttgagaaacaacatcaagagtgaccaagttatcatcatccatgacgctttccaaccatacaattattgggatgacttcatgactgaaaacgatggctactggggtgtcactatcgaccatcatcactaccaagtctttgcttctgatcaattggaaagatccattgatgaacatattaaagtagcttgtgaatggggtaccggagttttgaatgaatcccactggactgtttgtggtgagtttgctgccgctttgactgattgtacaaaatggttgaatagtgttggcttcggcgctagatacgacggttcttgggtcaatggtgaccaaacatcttcttacattggctcttgtgctaacaacgatgatatagcttactggtctgacgaaagaaaggaaaacacaagacgttatgtggaggcacaactagatgcctttgaaatgagagggggttggattatctggtgttacaagacagaatctagtttggaatgggatgctcaaagattgatgttcaatggtttattccctcaaccattgactgacagaaagtatccaaaccaatgtggcacaatttctaactaa

SEQ ID NO: 229 - protein, 448 aa, Saccharomyces cerevisiae
MLSLKTLLCTLLTVSSVLATPVPARDPSSIQFVHEENKKRYYDYDHGSLGEPIRGVNIGGWLLLEPYITPSLFEAFRTNDDNDEGIPVDEYHFCQYLGKDLAKSRLQSHWSTFYQEQDFANIASQGFNLVRIPIGYWAFQTLDDDPYVSGLQESYLDQAIGWARNNSLKVWVDLHGAAGSQNGFDNSGLRDSYKFLEDSNLAVTTNVLNYILKKYSAEEYLDTVIGIELINEPLGPVLDMDKMKNDYLAPAYEYLRNNIKSDQVIIIHDAFQPYNYWDDFMTENDGYWGVTIDHHHYQVFASDQLERSIDEHIKVACEWGTGVLNESHWTVCGEFAAALTDCTKWLNSVGFGARYDGSWVNGDQTSSYIGSCANNDDIAYWSDERKENTRRYVEAQLDAFEMRGGWIIWCYKTESSLEWDAQRLMFNGLFPQPLTDRKYPNQCGTISN

SEQ ID NO: 230 - DNA, 1689 bp, Saccharomyces cerevisiae
  CDS (1)..(1689)
atgcctttgaagtcgttttttttttcagcatttctagttttatgcctgtctaaattcacgcaaggcgttggcaccacagagaaggaagaatcgttatcgcctttggaactaaatattttacaaaacaaattcgcctcctactatgcaaacgacactatcaccgtgaaaggtattactattggcggctggctagtaacagaaccttatatcacgccatcattatatcgtaatgctacgtcactggcaaaacagcaaaactcttccagcaatatctccattgtcgacgaatttactctttgtaaaaccttaggatataacacctctctaactttattggataatcacttcaaaacttggattacagaggatgattttgaacaaatcaaaaccaacggtttcaatttagttaggatccccatcggatattgggcgtggaaacaaaatactgataaaaacttgtacatcgataacataactttcaatgatccatacgtaagtgatggattacaactgaaatatttaaataatgctctcgaatgggcgcaaaagtacgaactaaatgtatggttagatctacatggtgctcctggatcccagaatggattcgataattccggtgaaagaatactctatggcgatttaggctggttaaggttgaataatactaaagaactgactctggctatttggagagatatgttccagacatttttaaataaaggtgacaaaagtcctgtggtgggtattcaaatcgtcaacgaaccgcttggtggcaaaatcgatgtttcagacataacggagatgtattacgaagcatttgacttgctcaagaaaaatcagaattcgagtgacaacactacgtttgttattcatgacggttttcaaggaatcggtcactggaacttggagctaaacccaacctaccagaatgtatcgcatcattatttcaatttgactggtgcaaattacagctctcaagatatattggtcgaccatcatcattatgaagtgtttactgatgcgcaattggccgaaactcagtttgcacgtattgaaaacattatcaattatggggactctatccacaaagaactttcttttcacccagcagtagtcggagaatggtcaggcgctattactgattgtgcaacctggctaaatggtgttggggtgggtgcacgttacgatggatcatactacaatacaacgttgtttaccaccaacgacaagccagttggaacatgtatatcccaaaatagcttagctgattggacgcaagattaccgtgaccgtgtgagacaattcattgaggcacagctagccacttattcgtcaaaaacaacgggatggattttttggaattggaagaccgaagacgccgtagaatgggattatttgaagctaaaagaagctaaccttttcccttcccctttcgacaactacacgtacttcaaagcagatggatctatcgaagaaaaattctcatcctctttatcagcacaggcatttccaagaacaacgtcatcggttttgtcctccactacgacttccaggaagagtaagaatgctgcaatttctaataaactaacaacttcgcagctattaccaatcaaaaatatgagtttgacctggaaagcgagcgtatgcgcactcgctatcaccattgccgctctttgcgcttctctttaa

SEQ ID NO: 231 - protein, 562 aa, Saccharomyces cerevisiae
MPLKSFFFSAFLVLCLSKFTQGVGTTEKEESLSPLELNILQNKFASYYANDTITVKGITIGGWLVTEPYITPSLYRNATSLAKQQNSSSNISIVDEFTLCKTLGYNTSLTLLDNHFKTWITEDDFEQIKTNGFNLVRIPIGYWAWKQNTDKNLYIDNITFNDPYVSDGLQLKYLNNALEWAQKYELNVWLDLHGAPGSQNGFDNSGERILYGDLGWLRLNNTKELTLAIWRDMFQTFLNKGDKSPVVGIQIVNEPLGGKIDVSDITEMYYEAFDLLKKNQNSSDNTTFVIHDGFQGIGHWNLELNPTYQNVSHHYFNLTGANYSSQDILVDHHHYEVFTDAQLAETQFARIENIINYGDSIHKELSFHPAVVGEWSGAITDCATWLNGVGVGARYDGSYYNTTLFTTNDKPVGTCISQNSLADWTQDYRDRVRQFIEAQLATYSSKTTGWIFWNWKTEDAVEWDYLKLKEANLFPSPFDNYTYFKADGSIEEKFSSSLSAQAFPRTTSSVLSSTTTSRKSKNAAISNKLTTSQLLPIKNMSLTWKASVCALAITIAALCASL

SEQ ID NO: 232 - DNA, 2127 bp, Saccharomyces cerevisiae
  CDS (1)..(2127)
atggctcgtgacttacaaaatcatctactgttcgaagtagcaacagaagtagctaacagggttggtggtatttactctgtcttgaagtccaaggccccagtcactgtggcacaatacggagacaactatacgctgcttggacctttgaacaaggcgacttatgaaagtgaggttgaaaaacttgactgggaagatgaaagtatctttcctgaagagctgttaccaatccaaaaaactttgatgtccatgcgggaaaagggtgtgaactttgtctacggtaactggttgattgagggagcaccacgtgtcattttatttgagctggattctgtaagacactttttgaacgaatggaaggctgacctatggtctctcgtcggaattccatcaccagagcatgatcacgaaacaaacgatgccatattgttgggttatgttgttgtgtggtttttgggagaagtttcaaaattggacagtagccatgccatcattggccatttccatgaatggctagctggtgtagccctgccattgtgtagaaagaaaagaattgatgttgtaacgattttcaccacgcacgcaactttattgggtagatacttgtgtgccgctggtgatgtagatttttataacaatctacagtattttgatgtggaccaagaagctggtaagagaggcatatatcataggtactgcattgagcgcgctgcggctcatactgccgatgtttttacgactgtgtcgcaaatcactgcattagaagcggagcatttgttgaagaggaaaccggatggtatcttgcccaatggtttgaacgttgttaagtttcaagcagtacatgaatttcaaaatctgcatgccctgaaaaaagacaaaattaatgatttcgtcagaggccatttccatggttgttttgatttcgatctagacaacacagtttatttctttatcgctggtagatatgaatacaaaaacaaaggtgctgacatgttcattgaatcattggctcgtctcaattacagattgaaggtttctggatccaagaagactgtggtagcgtttttgatcatgcctgccaaaaccaattccttcactgtggaggcactgaaaagccaagccattgtaaaatctttggaaaatactgttaatgaggtcaccgcatccattgggaagagaattttcgagcatacgatgagataccctcataatggcctagaatcagagttgcccactaatttggatgagctgttgaagagttctgaaaaggttttgctgaagaaaagggtattggcgctgagaagaccttacggggaactgcctccggtagtcacgcataacatgtgcgatgatgctaacgatccaattttaaaccaaattagacatgttagattattcaatgattcgagtgatcgtgtaaaagtgattttccatcctgaattcctaaacgccaataaccctatccttggtttggattatgacgagtttgttcgcggctgtcacttgggtgtttttccatcctattacgaaccatgggggtacacgccagcagaatgtaccgtcatgggtgtcccatctatcacaacaaacgtttctgggttcggtgcctacatggaagacttgattgaaacagaccaagcgaaagactatggtatttatattgtagaccgtcgtttcaagagtcctgatgaatctgtcgagcaattagcagattacatggaagagtttgtaaacaagaccagaagacaaagaatcaaccaaagaaacagaaccgaaagactatcagacttgttagattggaagagaatggggttggaatacgttaaggctagacagttaggtcttcgtagggcctatccagagcagttcaagcaattggtgggtgaaacaattagtgacgccaatatgaacactcttgccggtggcaagaaattcaagattgccaggcctttgagtgtacccggatcccccaaagtaaggtccaatagtactgtttacatgactccgggcgatttaggtacccttcaagatgctaataatgcagatgactattttaatttgagcacgaatggagccatcgacaatgacgatgatgacaacgatacgtctgcatactacgaggataattaa

SEQ ID NO: 233 - protein, 708 aa, Saccharomyces cerevisiae
MARDLQNHLLFEVATEVANRVGGIYSVLKSKAPVTVAQYGDNYTLLGPLNKATYESEVEKLDWEDESIFPEELLPIQKTLMSMREKGVNFVYGNWLIEGAPRVILFELDSVRHFLNEWKADLWSLVGIPSPEHDHETNDAILLGYVVVWFLGEVSKLDSSHAIIGHFHEWLAGVALPLCRKKRIDVVTIFTTHATLLGRYLCAAGDVDFYNNLQYFDVDQEAGKRGIYHRYCIERAAAHTADVFTTVSQITALEAEHLLKRKPDGILPNGLNVVKFQAVHEFQNLHALKKDKINDFVRGHFHGCFDFDLDNTVYFFIAGRYEYKNKGADMFIESLARLNYRLKVSGSKKTVVAFLIMPAKTNSFTVEALKSQAIVKSLENTVNEVTASIGKRIFEHTMRYPHNGLESELPTNLDELLKSSEKVLLKKRVLALRRPYGELPPVVTHNMCDDANDPILNQIRHVRLFNDSSDRVKVIFHPEFLNANNPILGLDYDEFVRGCHLGVFPSYYEPWGYTPAECTVMGVPSITTNVSGFGAYMEDLIETDQAKDYGIYIVDRRFKSPDESVEQLADYMEEFVNKTRRQRINQRNRTERLSDLLDWKRMGLEYVKARQLGLRRAYPEQFKQLVGETISDANMNTLAGGKKFKIARPLSVPGSPKVRSNSTVYMTPGDLGTLQDANNADDYFNLSTNGAIDNDDDDNDTSAYYEDN

SEQ ID NO: 234 - DNA, 2118 bp, Saccharomyces cerevisiae
  CDS (1)..(2118)
atgtcccgtgacctacaaaaccatttgttattcgagactgcgactgaggttgctaatagggttggtggtatttactccgtgctaaaatcgaaggctcccattacggttgcccagtataaagaccattaccacttgatagggcccttaaataaagccacttatcaaaatgaagttgatatactagattggaagaagcctgaggccttttccgatgaaatgaggccagtgcagcatgccctgcaaacaatggaatctagaggagttcattttgtttatgggaggtggctgattgaaggtgctccaaaagtaatactttttgacttggattctgtgagaggttattcgaatgaatggaagggtgatttatggtcattagtaggaattccctctcctgagaatgatttcgagacgaatgatgctatcctattggggtatacagtcgcttggtttctaggcgaagtggctcatctcgattcacaacacgcaattgttgcgcactttcacgaatggttggccggtgttgcgttaccattatgccgtaaaaggcgtatcgatgtagttaccattttcaccactcatgctactttattgggacggtatttatgcgcctccggcagtttcgatttttacaattgtttagaatctgttgatgttgatcacgaagctggcagatttggcatataccatcgttattgtatagagagagcggcggctcattctgcagacgtattcactacggtgtcacaaataactgcttttgaagcggaacatcttttgaaaagaaaaccagatgggattttgcctaatggactgaacgtcatcaaatttcaagcatttcatgagttccaaaatttgcatgctttgaaaaaagaaaaaatcaatgactttgtaagaggccattttcatggttgcttcgatttcgatctagacaacaccttgtacttttttattgctggtagatatgagtataaaaataagggtgctgacatgtttattgaggctctagcgcgtttgaactacagattaaaagtatctggatccaaaaaaactgtggtagcgtttattgtcatgcccgccaaaaataattccttcactgttgaagcattgaagggccaggctgaggtgagggcgttagaaaatactgtacacgaagtgactacttcaattggtaaaagaatattcgatcatgctatcaggtacccccacaatgggctgacgacggaattaccaaccgatttgggtgaattactaaagagttcggataaagttatgttaaagagacgtattttggctttgagaaggccggagggacagttacccccaatagttacacacaatatggtcgatgacgctaatgacctgattttaaataaaatcagacaagttcaattgttcaatagcccaagtgatcgtgttaaaatgatcttccatccagaatttttgaacgctaataatccgatccttggtttagattatgatgagttcgttcgtggttgccatttgggtgttttcccttcatactacgagccttggggttacacacctgcagaatgtacagtaatgggtgttccctccatcacgacaaatgtctctggcttcggttcctatatggaagacttgatcgaaaccaaccaagcaaaagattacggtatttatattgtggatcgtcgtttcaaggcacctgatgaatctgtggaacaattagttgactacatggaagaatttgtaaaaaagacaagaaggcaaagaattaatcaaagaaatagaactgaaagactgtccgacttactggactggaaaagaatgggtctcgaatacgtcaaggcaaggcagttagcattaagaagaggctatcctgatcagttcagagagctcgttggtgaagaactaaatgattccaacatggatgctctagcaggcggaaagaaattgaaagttgcaagaccgcttagtgtacctggctcaccaagagatttgagatcaaacagcacagtctacatgacccctggtgatttgggtactctgcaggaggttaataacgcggacgattatttttcattgggagtgaatcctgcagctgacgatgacgacgatggcccatatgctgatgacagttaa

SEQ ID NO: 235 - protein, 705 aa, Saccharomyces cerevisiae
MSRDLQNHLLFETATEVANRVGGIYSVLKSKAPITVAQYKDHYHLIGPLNKATYQNEVDILDWKKPEAFSDEMRPVQHALQTMESRGVHFVYGRWLIEGAPKVILFDLDSVRGYSNEWKGDLWSLVGIPSPENDFETNDAILLGYTVAWFLGEVAHLDSQHAIVAHFHEWLAGVALPLCRKRRIDVVTIFTTHATLLGRYLCASGSFDFYNCLESVDVDHEAGRFGIYHRYCIERAAAHSADVFTTVSQITAFEAEHLLKRKPDGILPNGLNVIKFQAFHEFQNLHALKKEKINDFVRGHFHGCFDFDLDNTLYFFIAGRYEYKNKGADMFIEALARLNYRLKVSGSKKTVVAFIVMPAKNNSFTVEALKGQAEVRALENTVHEVTTSIGKRIFDHAIRYPHNGLTTELPTDLGELLKSSDKVMLKRRILALRRPEGQLPPIVTHNMVDDANDLILNKIRQVQLFNSPSDRVKMIFHPEFLNANNPILGLDYDEFVRGCHLGVFPSYYEPWGYTPAECTVMGVPSITTNVSGFGSYMEDLIETNQAKDYGIYIVDRRFKAPDESVEQLVDYMEEFVKKTRRQRINQRNRTERLSDLLDWKRMGLEYVKARQLALRRGYPDQFRELVGEELNDSNMDALAGGKKLKVARPLSVPGSPRDLRSNSTVYMTPGDLGTLQEVNNADDYFSLGVNPAADDDDDGPYADDS

SEQ ID NO: 236 - DNA, 1107 bp, Saccharomyces cerevisiae
  CDS (1)..(1107)
atgaatcctaaatcctctacacctaagattccaagacccaagaacgcatttattctgttcagacagcactaccacaggatcttaatagacgaatggaccgctcaaggtgtggaaataccccataattcaaacatttctaaaattattggtacgaagtggaagggcttacaaccggaagataaggcacactgggaaaatctagcggagaaggagaaactagaacataaaaggaagtatcctgaatacaaatacaagccggtaagaaagtctaagaagaagcaactacttttgaaggaaatcgagcaacagcagcagcaacaacagaaagaacagcagcagcagaaacagtcacaaccgcaattacaacagccctttaacaacaatatagttcttatgaaaagagcacattctctttcaccatcttcctcggtgtcaagctcgaacagctatcagttccaattgaacaatgatcttaagaggttgcctattccttctgttaatacttctaactatatggtctccagatctttaagtggactacctttgacgcatgataagacggcaagagacctaccacagctgtcatctcaactaaattctattccatattactcagctccacacgacccttcaacgagacatcattacctcaacgtcgctcaagctcaaccaagggctaactcgacccctcaattgccctttatttcatccattatcaacaacagcagtcaaacaccggtaactacaactaccacatccacaacaactgcgacatcttctcctgggaaattctcctcttctccgaactcctctgtactggagaacaacagattaaacagtatcaacaattcaaatcaatatttacctccccctctattaccttctctgcaagattttcaactggatcagtaccagcagctaaagcagatgggaccaacttatattgtcaaaccactgtctcacaccaggaacaatctattgtccacaactacccctacgcatcatcacattcctcatataccaaaccaaaacattcctctacatcaaattataaactcaagcaacactgaggtcaccgctaaaactagcctagtttctccgaaatga

SEQ ID NO: 237 - protein, 368 aa, Saccharomyces cerevisiae
MNPKSSTPKIPRPKNAFILFRQHYHRILIDEWTAQGVEIPHNSNISKIIGTKWKGLQPEDKAHWENLAEKEKLEHKRKYPEYKYKPVRKSKKKQLLLKEIEQQQQQQQKEQQQQKQSQPQLQQPFNNNIVLMKRAHSLSPSSSVSSSNSYQFQLNNDLKRLPIPSVNTSNYMVSRSLSGLPLTHDKTARDLPQLSSQLNSIPYYSAPHDPSTRHHYLNVAQAQPRANSTPQLPFISSIINNSSQTPVTTTTTSTTTATSSPGKFSSSPNSSVLENNRLNSINNSNQYLPPPLLPSLQDFQLDQYQQLKQMGPTYIVKPLSHTRNNLLSTTTPTHHHIPHIPNQNIPLHQIINSSNTEVTAKTSLVSPK

SEQ ID NO: 238 - DNA, 1713 bp, Saccharomyces cerevisiae
  CDS (1)..(1713)
atgaaagaatcccctctcataacgttggttaaaagacattccgagacacattttgccaatatcaagtatgggtattatgtgttgataatatcattggtctatctcattggattggctcttttgagagctttcggaaggagaaccccatccagatcgtcgtcagctttcaaaaataagataatttatcggttgtatgatatagatcctgcaattcacttaggtatattgttttttgcagtcttgattccattttattaccattactctttgactacccaatctacggtctatctcaaaagattagggaggttgagttacgccttgatcccgctgaacctattcctcactttaaggcctaattggttccttaggaaaaattgcacctacactgattttataccgttccataaatggttttcacgtattatcaccgtgattggtttgcttcatgggattttcttcatcattaagtgggcgatagacgataatgtctctctaaagcaaaaattgattctgaaaactttcaattttgcgggattcataatatcaatattggtactttttttacttatttgctcgattgggccaatgagaagatacaactatcgtttgttttacatcgtacataacctggtgaacgtggccttcatcttactcaccccaatacactctaggccaggtgttaagttcccatttcttctactaaactgtaccctattattcattcatattatcaatagaatagtatttgcgaaatccttgatgattttgaataagaatgcgaattattcaaaaacaaatttagtccatgtaagattgcccagggctattcttccagattattttgaaccagggtcgcatattagaataagcccttacagaagaattaatcccctctattggttgctaccatcgcatccatacacaattgcgtctttggcagaagacaattcaattgatcttattataaaggaaacctctacagccgagccaggtagccagatagagtctcttcgtagtaatccaaaatcctttcatttagatcaagaaaaaacctatactttgattaatagttatcctccctctgtacccgaagaatgttattctcaaggcacgaatatagctattatatgtggtgggtctggtatatcttttgccctaccactatttaggcatttttttaacaaggagaatgtaaaatacttgaaaatgatctggctgataaaagattactctgaatatgaacttgttttggattatctcaagacaaatgggttgacttttgagaaaaaactctcgaataataagaggatttcagtatttattagtggagaatacacggcggaaacacggttagacgaaattacgaccaatatcgacgatgaaaactcagaatatgaaatgggatctttcaacaatgaagacgaagacctttcgatttctaatttcaattcagaaaatgcggacagcaatgacaatacgccagagacaagtcatagccccacaaaagagaatggaagcatgatcgaggtaaaatccaaacacagttttactctttccaacgaattgaagagcttcaacaatgaaagtgcacaagtgaaccaaaatgaaacatggttgttttcatgtggtcctccctcgttattacaattgtctaaaaaatattgtaacgatgaaaggatcaactttgtctgtgagacttacggattatga

SEQ ID NO: 239 - protein, 570 aa, Saccharomyces cerevisiae
MKESPLITLVKRHSETHFANIKYGYYVLIISLVYLIGLALLRAFGRRTPSRSSSAFKNKIIYRLYDIDPAIHLGILFFAVLIPFYYHYSLTTQSTVYLKRLGRLSYALIPLNLFLTLRPNWFLRKNCTYTDFIPFHKWFSRIITVIGLLHGIFFIIKWAIDDNVSLKQKLILKTFNFAGFIISILVLFLLICSIGPMRRYNYRLFYIVHNLVNVAFILLTPIHSRPGVKFPFLLLNCTLLFIHIINRIVFAKSLMILNKNANYSKTNLVHVRLPRAILPDYFEPGSHIRISPYRRINPLYWLLPSHPYTIASLAEDNSIDLIIKETSTAEPGSQIESLRSNPKSFHLDQEKTYTLINSYPPSVPEECYSQGTNIAIICGGSGISFALPLFRHFFNKENVKYLKMIWLIKDYSEYELVLDYLKTNGLTFEKKLSNNKRISVFISGEYTAETRLDEITTNIDDENSEYEMGSFNNEDEDLSISNFNSENADSNDNTPETSHSPTKENGSMIEVKSKHSFTLSNELKSFNNESAQVNQNETWLFSCGPPSLLQLSKKYCNDERINFVCETYGL

SEQ ID NO: 240 - DNA, 1851 bp, Saccharomyces cerevisiae
  CDS (1)..(1851)
atgtcgtcgtcaattacagatgagaaaatatctggtgaacagcaacaacctgctggcagaaaactatactataacacaagtacatttgcagagcctcctctagtggacggagaaggtaaccctataaattatgagccggaagtttacaacccggatcacgaaaagctataccataacccatcactgcctgcacaatcaattcaggatacaagagatgatgaattgctggaaagagtttatagccaggatcaaggtgtagagtatgaggaagatgaagaggataagccaaacctaagcgctgcgtccattaaaagttatgctttaacgagatttacgtccttactgcacatccacgagttttcttgggagaatgtcaatcccatacccgaactgcgcaaaatgacatggcagaattggaactatttttttatgggttattttgcgtggttgtctgcggcttgggccttcttttgcgtttcagtatcagtcgctccattggctgaactatatgacagaccaaccaaggacatcacctgggggttgggattggtgttatttgttcgttcagcaggtgctgtcatatttggtttatggacagataagtcttccagaaagtggccgtacattacatgtttgttcttatttgtcattgcacaactctgtactccatggtgtgacacatacgagaaatttctgggcgtaaggtggataaccggtattgctatgggaggaatttacggatgtgcttctgcaacagcgattgaagatgcacctgtgaaagcacgttcgttcctatcaggtctatttttttctgcttacgctatggggttcatatttgctatcattttttacagagcctttggctactttagggatgatggctggaaaatattgttttggtttagtatttttctaccaattctactaattttctggagattgttatggcctgaaacgaaatacttcaccaaggttttgaaagcccgtaaattaatattgagtgacgcagtgaaagctaatggtggcgagcctctaccaaaagccaactttaaacaaaagatggtatccatgaagagaacagttcaaaagtactggttgttgttcgcatatttggttgttttattggtgggtccaaattacttgactcatgcttctcaagacttgttgccaaccatgctgcgtgcccaattaggcctatccaaggatgctgtcactgtcattgtagtggttaccaacatcggtgctatttgtgggggtatgatatttggacagttcatggaagttactggaagaagattaggcctattgattgcatgcacaatgggtggttgcttcacctaccctgcatttatgttgagaagcgaaaaggctatattaggtgccggtttcatgttatatttttgtgtctttggtgtctggggtatcctgcccattcaccttgcagagttggcccctgctgatgcaagggctttggttgccggtttatcttaccagctaggtaatctagcttctgcagcggcttccacgattgagacacagttagctgatagatacccattagaaagagatgcctctggtgctgtgattaaagaagattatgccaaagttatggctatcttgactggttctgttttcatcttcacatttgcttgtgtttttgttggccatgagaaattccatcgtgatttgtcctctcctgttatgaagaaatatataaaccaagtggaagaatacgaagccgatggtctttcgattagtgacattgttgaacaaaagacggaatgtgcttcagtgaagatgattgattcgaacgtctcaaagacatatgaggagcatattgagaccgtttaa

SEQ ID NO: 241 - protein, 616 aa, Saccharomyces cerevisiae
MSSSITDEKISGEQQQPAGRKLYYNTSTFAEPPLVDGEGNPINYEPEVYNPDHEKLYHNPSLPAQSIQDTRDDELLERVYSQDQGVEYEEDEEDKPNLSAASIKSYALTRFTSLLHIHEFSWENVNPIPELRKMTWQNWNYFFMGYFAWLSAAWAFFCVSVSVAPLAELYDRPTKDITWGLGLVLFVRSAGAVIFGLWTDKSSRKWPYITCLFLFVIAQLCTPWCDTYEKFLGVRWITGIAMGGIYGCASATAIEDAPVKARSFLSGLFFSAYAMGFIFAIIFYRAFGYFRDDGWKILFWFSIFLPILLIFWRLLWPETKYFTKVLKARKLILSDAVKANGGEPLPKANFKQKMVSMKRTVQKYWLLFAYLVVLLVGPNYLTHASQDLLPTMLRAQLGLSKDAVTVIVVVTNIGAICGGMIFGQFMEVTGRRLGLLIACTMGGCFTYPAFMLRSEKAILGAGFMLYFCVFGVWGILPIHLAELAPADARALVAGLSYQLGNLASAAASTIETQLADRYPLERDASGAVIKEDYAKVMAILTGSVFIFTFACVFVGHEKFHRDLSSPVMKKYINQVEEYEADGLSISDIVEQKTECASVKMIDSNVSKTYEEHIETV

SEQ ID NO: 242 - DNA, 396 bp, Saccharomyces cerevisiae
  CDS (1)..(396)
atgacacttgtagtatatctaactcggttttcttccactagaagcctcaaattctttgttgttggtatcacatcattcaaaaactgcagatggccgtcagaagagtgcacaattgcggcagagatgtcatcgtacgacagcgtgagttcatctgggagcggcggtacctgttgttgttgctgctgctgttgcctatgtagggactcatgtgtcagcacctggacgaagaattctgtagcaaacgctgtggctacgaatgcgtcatccgaagtgtccatatattctggatcattcttggctattctctgcactttttctacaggtaacttgggcgaacacagaggtgcagacgccgtttctttaccactagtctcgttgttcattgtgttagcctga

SEQ ID NO: 243 - protein, 131 aa, Saccharomyces cerevisiae
MTLVVYLTRFSSTRSLKFFVVGITSFKNCRWPSEECTIAAEMSSYDSVSSSGSGGTCCCCCCCCLCRDSCVSTWTKNSVANAVATNASSEVSIYSGSFLAILCTFSTGNLGEHRGADAVSLPLVSLFIVLA

SEQ ID NO: 244 - DNA, 405 bp, Saccharomyces cerevisiae
  CDS (1)..(405)
atgatagaattggattatgtaaaaggtgaagataccattgtagaagcaaccagcacgtcgccgtggctgatgaggtctcctcttgcccgggccgcagaaaagaggggcagtggcctgtttttcgacataaatgaggggcatggccagcaccgagacgtcattgttgcatatggcgtatccaagccgaaacggcgctcgcctcatccccacgggaataaggcagccgacaaaagaaaaacgaccgaaaaggaaccagaaagaaaaaagagggtgggcgcgccgcggacgtgtaaaaagatatgcatccagcttctatatcgctttaactttaccgttttgggcatcgggaacgtatgtaacattgatctcctcttgggaacggtgagtgcaacgaatgcgatatag

SEQ ID NO: 245 - protein, 134 aa, Saccharomyces cerevisiae
MIELDYVKGEDTIVEATSTSPWLMRSPLARAAEKRGSGLFFDINEGHGQHRDVIVAYGVSKPKRRSPHPHGNKAADKRKTTEKEPERKKRVGAPRTCKKICIQLLYRFNFTVLGIGNVCNIDLLLGTVSATNAI

SEQ ID NO: 246 - DNA, 2073 bp, Yarrowia lipolytica
atgacgagggacacacgaaaccacctgctgttcgaggtcgccaccgaggtcgccaaccgggtcggcggaatctactcggtcatcaagtccaaggcccccgtcaccgtctacgagtacggggaccggtaccacctgattggacccctcaaccgcaagtcggccgacattgaggtggaggagatcaccgacgagtcccagattcccgaagccatcaacaaaacactaaagtccatggcggaacgaggcatccagtacgtctacggccgatggctcattgagggcgctccccgagtcattctcttcgacctgggctccgcctggggctaccttcccgagtggaagagtgatctgtggactgtggccggtatccccgcccccgagggcgacaaggagtccaacgacgccgttgtgttgggctacttggtggcctggttcctgggagagctgaccacccacgaaaccgagcgggccgtcattgcccacttccacgagtggctgtccggtattgctctgcctctgtgcaaaaagcgacgaatcgactgcaccaccatcttcaccacacacgctactctgctgggccgatacctgtgcgccggctcggtcgacttctacaacaacctgcagggcttcgacgtggacgccgaggccggaaagcgaggcatctaccaccgatattgcattgagcgggcggcttcccactcggccgacgttttcaccaccgtgtcgcacatcaccgcctacgagtccgagcacctgctcaagcgaaagcccgacggtgtggtgcccaacggtctcaacgtggtcaagttttcggccatgcacgagttccagaacctgcatgccctgatgaaggacaagatcaaccagtttgtcaagggccacttttacggtcacctggactttgatctcgacgacactctgtatacctttactgccggccgatacgagtaccgaaacaagggtgtagacatgttcatcgagtctctcgcccgtctcaaccacagattgaagagtgagaagtccaccaagaccattgtggcctttatcatcatgcccgcccagacctcatcatacacagtggagaccctcaagggccaggccgttatgaaggctctggaggacaccgtcaacgaaatccagcagcagattggccgacgaatgctcgaccattgtgcccgccacaacagccacgacggaaaggagatccccggcctcgaccagctgctttccccctccgacagagtgctgctcaagcgacgagtgtttgccctcaagcgagaaaccttccctcccattgtcacccacaacatggtggacgactccacagaccccattctcaaccagatccgacgggtacagctgttcaaccggcccgaggaccgggtcaagattatcttccaccccgagttcctcaactccaacaaccctatcctgcctctcgactacgacgactttgtgcgaggctgtcatctcggagtcttcccctcctactacgagccttggggatacacccccgccgagtgcaccgtcatgggcgttccttccatcaccaccaacctctctggtttcggctgctacatggaggatctcattgagaacgcctccgactacggcatctacattgtggaccgtcgtctcaagtctattgacgagagtgttgaccagctaaccgactacatgtttgagttctccaagaagtcgcgacgtcagcgaattaaccagcgaaaccgaaccgagcgactgtccgatctgctggactggaagcgaatgggccgagagtacatcaaggctcgacagctggctcttcgacgagcctaccccgaccagtttgaccacgaggagaaccccttcgaagacgaggagcctctcaagctgactcgacctctatctgtgcctggatccccccgtgaccgagccggtctcatgactcccggtgatcttggatctctgggtgagattggcgagggtcttgacactgacgattatgtgggcttccgacttccccaggatgatgatgacgaggaggagactagctaccctgccactctcactctagccggtagcagaaagtag

SEQ ID NO: 247 - DNA, 32 bp, Artificial sequence
  Primer
attattaagcttcgacattgaggtggaggaga

SEQ ID NO: 248 - DNA, 32 bp, Artificial sequence
  Primer
taataaacgcgttgctgctggatttcgttgac

SEQ ID NO: 249 - DNA, 2073 bp, Yarrowia lipolytica; identical to SEQ ID NO: 246
  CDS (1)..(2073)

SEQ ID NO: 250 - protein, 690 aa, Yarrowia lipolytica
MTRDTRNHLLFEVATEVANRVGGIYSVIKSKAPVTVYEYGDRYHLIGPLNRKSADIEVEEITDESQIPEAINKTLKSMAERGIQYVYGRWLIEGAPRVILFDLGSAWGYLPEWKSDLWTVAGIPAPEGDKESNDAVVLGYLVAWFLGELTTHETERAVIAHFHEWLSGIALPLCKKRRIDCTTIFTTHATLLGRYLCAGSVDFYNNLQGFDVDAEAGKRGIYHRYCIERAASHSADVFTTVSHITAYESEHLLKRKPDGVVPNGLNVVKFSAMHEFQNLHALMKDKINQFVKGHFYGHLDFDLDDTLYTFTAGRYEYRNKGVDMFIESLARLNHRLKSEKSTKTIVAFIIMPAQTSSYTVETLKGQAVMKALEDTVNEIQQQIGRRMLDHCARHNSHDGKEIPGLDQLLSPSDRVLLKRRVFALKRETFPPIVTHNMVDDSTDPILNQIRRVQLFNRPEDRVKIIFHPEFLNSNNPILPLDYDDFVRGCHLGVFPSYYEPWGYTPAECTVMGVPSITTNLSGFGCYMEDLIENASDYGIYIVDRRLKSIDESVDQLTDYMFEFSKKSRRQRINQRNRTERLSDLLDWKRMGREYIKARQLALRRAYPDQFDHEENPFEDEEPLKLTRPLSVPGSPRDRAGLMTPGDLGSLGEIGEGLDTDDYVGFRLPQDDDDEEETSYPATLTLAGSRK

The invention claimed is:

1. A recombinant yeast selected from the group consisting of *Saccharomyces, Pichia, Kluyveromyces, Candida, Hansenula, Humicola, Trichosporon, Brettanomyces, Pachysolen, Yarrowia*, and *Yamadazyma*, comprising:
   (a) a heterologous nucleotide sequence encoding a polypeptide having ent-copalyl pyrophosphate synthase activity, wherein the nucleotide sequence comprises:
      i. a nucleotide sequence encoding the polypeptide having ent-copalyl pyrophosphate synthase activity, said polypeptide comprising an amino acid sequence that has at least 90% sequence identity with the amino acid sequence of SEQ ID NOs: 60 or 62;
      ii. a nucleotide sequence the complementary strand of which hybridizes to the sequence set forth in (i); or
      iii. a nucleotide sequence which differs from the sequence of a nucleic acid molecule of (i) or (ii) due to the degeneracy of the genetic code;
   (b) a heterologous nucleotide sequence encoding a polypeptide having ent-Kaurene synthase activity, wherein the nucleotide sequence comprises:
      i. a nucleotide sequence encoding the polypeptide having ent-Kaurene synthase activity, said polypeptide comprising an amino acid sequence that has at least 90% sequence identity with the amino acid sequence of SEQ ID NOs: 64 or 66;
      ii. a nucleotide sequence the complementary strand of which hybridizes to the sequence set forth in (i); or
      iii. a nucleotide sequence which differs from the sequence of a nucleic acid molecule of (i) or (ii) due to the degeneracy of the genetic code;
   (c) a heterologous nucleotide sequence encoding a polypeptide having ent-Kaurene oxidase activity, wherein the nucleotide sequence comprises:
      i. a nucleotide sequence encoding the polypeptide having ent-Kaurene oxidase activity, said polypeptide comprising an amino acid sequence that has at least 90% sequence identity with the amino acid sequence of SEQ ID NOs: 24 or 86;
      ii. a nucleotide sequence the complementary strand of which hybridizes to the sequence set forth in (i); or
      iii. a nucleotide sequence which differs from the sequence of a nucleic acid molecule of (i) or (ii) due to the degeneracy of the genetic code; and
   (d) a heterologous nucleotide sequence encoding a polypeptide having kaurenoic acid 13-hydroxylase activity, wherein the nucleotide sequence comprises:
      i. a nucleotide sequence encoding the polypeptide having kaurenoic acid 13-hydroxylase activity, said polypeptide comprising an amino acid sequence that has at least 90% sequence identity with the amino acid sequence of SEQ ID NOs: 32, 34, or 70;
      ii. a nucleotide sequence the complementary strand of which hybridizes to the sequence set forth in (i); or iii. a nucleotide sequence which differs from the sequence of a nucleic acid molecule of (i) or (ii) due to the degeneracy of the genetic code;

whereby the yeast produces steviol, and wherein said recombinant yeast has been modified in its genome to delete, disrupt, or replace at least one gene that encodes:

(i) an exo-1,3-β glucanase;
(ii) a glycogen synthase;
(iii) a transcriptional repressor of hypoxic genes (ROX1);
(iv) an NADPH oxidase;
(v) a monocarboxylate transporter (JEN1);
(vi) a YJL064w polypeptide; or
(vii) a YPL062w polypeptide.

2. The recombinant yeast of claim 1, wherein:
   (i) said exo-1,3-β glucanase comprises an amino acid sequence having at least 95% sequence identity with SEQ ID NO:229;
   (ii) said glycogen synthase comprises an amino acid sequence having at least 95% sequence identity with SEQ ID NO:250;
   (iii) said transcriptional repressor of hypoxic genes comprises an amino acid sequence having at least 95% sequence identity with SEQ ID NO: 237;
   (iv) said NADPH oxidase comprises an amino acid sequence having at least 95% sequence identity with SEQ ID NO:239;
   (v) said monocarboxylate transporter comprises an amino acid sequence having at least 95% sequence identity with SEQ ID NO:241;
   (vi) said YJL064w polypeptide comprises an amino acid sequence having at least 95% sequence identity with SEQ ID NO: 243; or
   (vii) said YJL062w polypeptide comprises an amino acid sequence having at least 95% sequence identity with SEQ ID NO: 245.

3. The recombinant yeast of claim 1, wherein the yeast further comprises one or more nucleotide sequences encoding a polypeptide having UDP-glucosyltransferase activity, whereby expression of the nucleotide sequence(s) further confer(s) on the yeast the ability to produce at least one of steviolmonoside, steviolbioside, stevioside, rebaudioside A, rebaudioside B, rebaudioside C, rebaudioside D, rebaudioside E, rebaudioside F, rubusoside, or dulcoside A.

4. The recombinant yeast of claim 3, wherein the yeast further comprises a nucleotide sequence encoding a polypeptide that catalyzes the addition of a C-13-glucose to steviol,
   whereby expression of the nucleotide sequence further confers on the yeast the ability to produce at least steviolmonoside.

5. The recombinant yeast of claim 3, wherein the yeast further comprises a nucleotide sequence encoding a polypeptide that catalyzes the addition of a glucose at C-13 position of steviol or steviolmonoside,
   whereby expression of the nucleotide sequence further confers on the yeast the ability to produce at least steviolbioside.

6. The recombinant yeast of claim 3, wherein the yeast further comprises a nucleotide sequence encoding a polypeptide that catalyzes the addition of a C-19-glucose to steviolbioside,
   whereby expression of the nucleotide sequence further confers on the yeast the ability to produce at least stevioside.

7. The recombinant yeast of claim 3, wherein the yeast further comprises a nucleotide sequence encoding a polypeptide that catalyzes glucosylation of the C-3' of the glucose at the C-13 position of stevioside,
   whereby expression of the nucleotide sequence further confers on the yeast the ability to produce at least rebaudioside A.

8. The recombinant yeast of claim 3, wherein the yeast further comprises a nucleotide sequence encoding a polypeptide that catalyzes the glucosylation of stevioside or rebaudioside A,
   whereby expression of the nucleotide sequence further confers on the yeast the ability to produce at least rebaudioside D.

9. The recombinant yeast of claim 3, wherein the yeast further comprises a nucleotide sequence encoding a polypeptide that catalyzes the glucosylation of stevioside,
   whereby expression of the nucleotide sequence further confers on the yeast the ability to produce at least rebaudioside E.

10. The recombinant yeast of claim 3, wherein the yeast further comprises a nucleotide sequence encoding a polypeptide that catalyzes the glucosylation of rebaudioside E,
    whereby expression of the nucleotide sequence further confers on the yeast the ability to produce at least rebaudioside D.

11. The recombinant yeast of claim 1, wherein the yeast expresses a nucleotide sequence encoding a polypeptide having NADPH-cytochrome p450 reductase activity.

12. The recombinant yeast of claim 3, which expresses a nucleotide sequence encoding a polypeptide that catalyzes the addition of a glucose at the C-13 position of steviol, wherein said nucleotide comprises:
    i. a nucleotide sequence encoding a polypeptide that catalyzes the addition of a glucose at the C-13 position of steviol, said polypeptide comprising an amino acid sequence that has at least 90% sequence identity with the amino acid sequence of SEQ ID NO:72;
    ii. a nucleotide sequence the complementary strand of which hybridizes to the sequence set forth in (i); or
    iii. a nucleotide sequence which differs from the sequence of a nucleic acid molecule of (i) or (ii) due to the degeneracy of the genetic code.

13. The recombinant yeast of claim 3, which expresses a nucleotide sequence encoding a polypeptide that catalyzes the addition of a glucose at the C-13 position of steviolmonoside, wherein said nucleotide comprises:
    i. a nucleotide sequence encoding a polypeptide that catalyzes the addition of a glucose at the C-13 position of steviolmonoside, said polypeptide comprising an amino acid sequence that has at least 90% sequence identity with the amino acid sequence of SEQ ID NO:88;
    ii. a nucleotide sequence the complementary strand of which hybridizes to the sequence set forth in (i); or
    iii. a nucleotide sequence which differs from the sequence of a nucleic acid molecule of (i) or (ii) due to the degeneracy of the genetic code.

14. The recombinant yeast of claim 3, which expresses a nucleotide sequence encoding a polypeptide that catalyzes the addition of a glucose at the C-19 position of steviolbioside, wherein said nucleotide sequence comprises:
    i. a nucleotide sequence encoding a polypeptide that catalyzes the addition of a glucose at the C-19 position of steviolbioside, said polypeptide comprising an amino acid sequence that has at least 90% sequence identity with the amino acid sequence of SEQ ID NO:74;
ii. a nucleotide sequence the complementary strand of which hybridizes to the sequence set forth in (i); or
iii. a nucleotide sequence which differs from the sequence of a nucleic acid molecule of (i) or (ii) due to the degeneracy of the genetic code.

15. The recombinant yeast of claim 3, which expresses a nucleotide sequence encoding a polypeptide that catalyzes glucosylation of the C-3' of the glucose at the C-13 position of stevioside, wherein said nucleotide sequence comprises:
    i. a nucleotide sequence encoding a polypeptide that catalyzes glucosylation of the C-3' of the glucose at the C-13 position of stevioside, said polypeptide comprising an amino acid sequence that has at least 90% sequence identity with the amino acid sequence of SEQ ID NO:76;
    ii. a nucleotide sequence the complementary strand of which hybridizes to the sequence set forth in (i); or
    iii. a nucleotide sequence which differs from the sequence of a nucleic acid molecule of (i) or (ii) due to the degeneracy of the genetic code.

16. The recombinant yeast of claim 3, which expresses a nucleotide sequence encoding a polypeptide that catalyzes one or more of: the glucosylation of stevioside or rebaudioside A to rebaudioside D; the glucosylation of stevioside to rebaudioside E; or the glucosylation of rebaudioside E to rebaudioside D, wherein said nucleotide sequence comprises:
    i. a nucleotide sequence encoding a polypeptide that catalyzes one or more of: the glucosylation of stevioside or rebaudioside A to rebaudioside D; the glucosylation of stevioside to rebaudioside E; or the glucosylation of rebaudioside E to rebaudioside D, said polypeptide comprising an amino acid sequence that has at least 90% sequence identity with the amino acid sequence of SEQ ID NO:88;
    ii. a nucleotide sequence the complementary strand of which hybridizes to the sequence set forth in (i); or
    iii. a nucleotide sequence which differs from the sequence of a nucleic acid molecule of (i) or (ii) due to the degeneracy of the genetic code.

17. The recombinant yeast of claim 1, wherein the yeast is a *Saccharomyces cerevisiae* cell, or a *Yarrowia lipolytica* cell.

18. The recombinant yeast of claim 1, wherein the ability of the yeast to produce geranylgeranyl diphosphate (GGPP) is upregulated.

19. The recombinant yeast of claim 18, comprising one or more nucleotide sequence(s) encoding hydroxymethylglutaryl-CoA reductase, farnesyl-pyrophosphate synthetase and geranylgeranyl diphosphate synthase, whereby expression of the nucleotide sequence(s) confer(s) on the yeast the ability to produce elevated levels of GGPP.

20. The recombinant yeast of claim 18, which expresses one or more of:
    a. a nucleotide sequence encoding a polypeptide having hydroxymethylglutaryl-CoA reductase activity, wherein said nucleotide sequence comprises:
        i. a nucleotide sequence encoding a polypeptide having hydroxymethylglutaryl-CoA reductase activity, said polypeptide comprising an amino acid sequence that has at least 90% sequence identity with the amino acid sequence of SEQ ID NO: 80;
        ii. a nucleotide sequence the complementary strand of which hybridizes to the sequence set forth in (i); or
        iii. a nucleotide sequence which differs from the sequence of a nucleic acid molecule of (i) or (ii) due to the degeneracy of the genetic code;
    b. a nucleotide sequence encoding a polypeptide having farnesyl-pyrophosphate synthetase activity, wherein said nucleotide sequence comprises:
        i. a nucleotide sequence encoding a polypeptide having farnesyl-pyrophosphate synthetase activity, said polypeptide comprising an amino acid sequence that has at least 90% sequence identity with the amino acid sequence of SEQ ID NO: 82;
        ii. a nucleotide sequence the complementary strand of which hybridizes to the sequence set forth in (i); or
        iii. a nucleotide sequence which differs from the sequence of a nucleic acid molecule of (i) or (ii) due to the degeneracy of the genetic code; or
    c. a nucleotide sequence encoding a polypeptide having geranylgeranyl diphosphate synthase activity, wherein said nucleotide sequence comprises:
        i. a nucleotide sequence encoding a polypeptide having geranylgeranyl diphosphate synthase activity, said polypeptide comprising an amino acid sequence that has at least 90% sequence identity with the amino acid sequence of SEQ ID NO: 84;
        ii. a nucleotide sequence the complementary strand of which hybridizes to the sequence set forth in (i); or
        iii. a nucleotide sequence which differs from the sequence of a nucleic acid molecule of (i) or (ii) due to the degeneracy of the genetic code.

21. A process for the preparation of steviol, comprising:
fermenting the yeast according to claim 1 in a fermentation medium; and
optionally recovering the steviol from the fermentation medium.

22. A process for the preparation of steviol, comprising:
fermenting the recombinant yeast of claim 1 in a fermentation medium at a temperature of about 29° C. or less; and
optionally recovering the steviol from the fermentation medium.

23. The process according to claim 22, wherein the fermentation is carried out at a temperature of about 28° C. or less.

24. The process according to claim 22, wherein the fermentation is carried out at a temperature of about 27° C. or less.

25. The process according to claim 22, wherein the fermentation is carried out at a temperature of about 26° C. or less.

26. The process according to claim 21, wherein the process is carried out on an industrial scale.

* * * * *